US008946512B2

(12) United States Patent
Frankard et al.

(10) Patent No.: US 8,946,512 B2
(45) Date of Patent: Feb. 3, 2015

(54) PLANTS HAVING ENHANCED YIELD-RELATED TRAITS AND A METHOD FOR MAKING THE SAME

(75) Inventors: Valerie Frankard, Waterloo (BE); Andry Andriankaja, Gent (BE); Yves Hatzfeld, Lille (FR); Marieke Louwers, Gent (BE); Steven Vandenabeele, Oudenaarde (BE); Aurine Verkest, Gent (BE); Geert De Jaeger, Evergem (BE); Dirk Inzé, Moorsel-Aalst (BE)

(73) Assignee: BASF Plant Science Company GmbH, Ludwigshafen (DE)

( * ) Notice: Subject to any disclaimer, the term of this patent is extended or adjusted under 35 U.S.C. 154(b) by 584 days.

(21) Appl. No.: 13/060,881

(22) PCT Filed: Aug. 31, 2009

(86) PCT No.: PCT/EP2009/061226
§ 371 (c)(1),
(2), (4) Date: Apr. 27, 2011

(87) PCT Pub. No.: WO2010/023320
PCT Pub. Date: Mar. 4, 2010

(65) Prior Publication Data
US 2011/0214207 A1    Sep. 1, 2011

Related U.S. Application Data

(60) Provisional application No. 61/190,543, filed on Aug. 29, 2008.

(51) Int. Cl.
C12N 15/82    (2006.01)
C12N 5/04     (2006.01)
C12N 15/00    (2006.01)
C07H 21/04    (2006.01)
A01H 5/00     (2006.01)

(52) U.S. Cl.
CPC ................. C12N 15/8261 (2013.01)
USPC ........... 800/290; 800/278; 800/298; 800/320; 800/320.1; 800/320.2; 800/320.3; 435/468; 435/419; 435/320.1; 536/23.6

(58) Field of Classification Search
None
See application file for complete search history.

(56) References Cited

U.S. PATENT DOCUMENTS

| 2004/0214272 A1 * | 10/2004 | La Rosa et al. ............ 435/69.1 |
| 2010/0199382 A1 | 8/2010 | Frankard et al. |
| 2010/0212041 A1 | 8/2010 | Frankard |
| 2010/0218271 A1 | 8/2010 | Sanz Molinero et al. |
| 2011/0214207 A1 | 9/2011 | Frankard et al. |
| 2012/0324602 A1 | 12/2012 | De Jaeger et al. |

FOREIGN PATENT DOCUMENTS

| EP | 1033405 A2 | 9/2000 |
| JP | 2004-350553 A | 12/2004 |
| WO | WO 00/56905 | * 9/2000 |
| WO | WO-00/56905 A2 | 9/2000 |
| WO | WO 2004/035798 A2 * | 4/2004 |
| WO | WO-2006/079655 A2 | 8/2006 |
| WO | WO 2006/079655 A2 * | 8/2006 |
| WO | WO-2008/015263 A2 | 2/2008 |
| WO | WO-2009/037338 A1 | 3/2009 |

OTHER PUBLICATIONS

Horiguchi et al (2005) The Plant Journal 43(1): 68-78.*
Kim et al (2004) PNAS 101(36):13374-13379.*
Horiguchi, Plant J, 43:68-78 (2005).*
Kim & Kende, Proc Natl Acad Sci USA 101(36):13374-79 (2004).*
Hurtado et al., "The Putative SWI/SNF Complex Subunit BRAHMA Activates Flower homeotic Genes in *Arabidopsis thaliana*", Plant. Mol. Biol., vol. 62, pp. 291-304 (2006).
Ge et al., "Overexpression of the Trehalose-6-Phosphate Phosphatase Gene *OsTPP1* Confers Stress Tolerance in Rice and Results in the Activation of Stress Responsive Genes", Planta, vol. 228, pp. 191-201 (2008).
Gerats et al., "A Two-Element system Controls Instability at the *An3* Locus in *Petunia hybrida*", Theor. App. Genet, vol. 70, pp. 245-247 (1985).
Bae et al., "Analysis of the Arabidopsis Nuclear Proteome and its Response to Cold Stress", The Plant Journal, vol. 36, pp. 652-663 (2003).
Van Leene et al., "A Tandem Affinity Purification-Based Technology Platform to Study the Cell cycle Interactome in *Arabidopsis Thaliana*", Molecular & Cellular Proteomics 6.7, pp. 1226-1238 (2007).

(Continued)

*Primary Examiner* — Medina A Ibrahim
*Assistant Examiner* — Russell Boggs
(74) *Attorney, Agent, or Firm* — Drinker Biddle & Reath LLP

(57) ABSTRACT

The present invention relates generally to the field of molecular biology and concerns a method for enhancing yield-related traits in plants by modulating expression in a plant of one or more nucleic acid(s) encoding at least two iSYT (interactor of SYT-synovial sarcoma translocation-) polypeptides. The present invention also concerns plants having modulated expression of a nucleic acid encoding at least two iSYT polypeptides, which plants have enhanced yield-related traits relative to corresponding wild type plants or other control plants. The invention also provides hitherto unknown nucleic acids encoding at least two iSYT polypeptides, and constructs comprising the same, useful in performing the methods of the invention. The invention also provides constructs useful in the methods of the invention. Furthermore the present invention also relates to an iSYT-based protein complex. It further relates to the use of the complex to promote plant growth, and to a method for stimulating the complex formation, by overexpressing at least two members of the complex.

28 Claims, 3 Drawing Sheets

(56) References Cited

OTHER PUBLICATIONS

Bailey et al., "Update on the Basic Helix-Loop-Helix Transcription Factor Gene Family in *Arabidopsis thaliana*", *Plant Cell*, vol. 15, pp. 2497-2502 (2003).

Kim et al., "A Transcriptional Coactivator, AtGIF1, is Involved in Regulating Leaf Growth and Morphology in *Arabidopsis*", *PNAS*, vol. 101, No. 36, pp. 13374-13379 (2004).

TAIR Polymorphis/Allele Search Results, At1G05370, arabidopis.org, 2 pages, Mar. 29, 2013.

Avonce et al., "The *Arabidopsis* trehalose-6-P synthase *AtTPS1*, Gene is a Regulator of Glucose, Abscisic Acid, and Stress Signaling", *Plant Physiology*, vol. 136, pp. 3649-3659 (2004).

Bollman et al., "*Hasty*, the *Arabidopsis* Ortholog of Exportin 5/MSN5, Regulates Phase Change and Morphogenesis", *Development*, vol. 130, pp. 1493-1504 (2003).

Clark et al., "Identification of Novel Genes, SYT and SSX, Involved in the t(X;18)(p11.2;q11.2) Translocation Found in Human synovial Scarcoma", *Nature Genetic*, vol. 7, pp. 502-508 (1994).

Coursol et al., "*Arabidopsis* Sphingosine Kinase and the Effects of Phytosphingosine-1-Phosphate on Stomatal Aperture", *Plant Physiology*, vol. 137, pp. 724-737 (2005).

Crane et al., "RNAi-Mediated Gene Silencing Reveals Involvement of *Arabidopsis* Chromatin-Related Genes in *Arrobacterium*-Mediated Root Transformation", *PNAS*, vol. 104, No. 38, pp. 15156-15161 (2007).

de Bruijn et al., "Isolation and Characterization of the Mouse Homolog of *SYT*, a Gene Implicated in the Development of Human Synovial Scarcomas", *Oncogene*, vol. 13, pp. 643-648 (1996).

Eastmond et al., "Trehalose-6-Phosphate Synthase 1, Which Catalyses the First Step in Trehalose Synthesis, is Essential for *Arabidopsis* Embryo Maturation", *The Plant Journal*, vol. 29, No. 2, pp. 225-235 (2002).

Farrona et al., "The *Arabidopsis thalian* SNF2 Homolog AtBRM Controls shoot Development and Flowering", *Development*, vol. 131, pp. 4965-4975 (2004).

Grennan, "The Role of Trehalose Biosynthesis in Plants", *Plant Physiology*, vol. 144, pp. 305 (2007).

Kim et al., "The AtGRF Family of Putative Transcription Factors is Involved in Leaf and cotyledon Growth in *Arabidopsis*", *The Plant Journal*, vol. 36, pp. 94-104 (2003).

Horiguchi et al., "Coordination of Cell Proliferation and Cell Expansion in the Control of Leaf Size in *Arabidopsis thaliana*", *J. Plant Res.*, vol. 119, pp. 37-42 (2006).

Kandasamy et al., "Silencing the Nuclear Actin-Related Protein AtARP4 in *Arabidopsis* has Multiple Effects on Plant Development, Including Early Flowering and Delayed Floral Senescence", *The Plant Journal*, vol. 41, pp. 845-858 (2005).

Kwon et al., "A Role for Chromatin Remodeling in Regulation of CUC Gene Expression in the *Arabidopsis* Cotyledon Boundary", *Development*, vol. 133, pp. 3223-3230 (2006).

Meagher et al., "Nuclear Actin-Related Proteins as Epigenetic Regulators of Development", *Plant Physiology*, vol. 139, pp. 1576-1585 (2005).

Sarnowski et al., "SWI3 Subunits of Putative SWI/SNF Chromatin-Remodeling Complexes Play Distinct Roles During *Arabidopsis* Development", *The Plant Cell*, vol. 17, pp. 2454-2472 (2005).

Van Camp, "Yield Enhancement Genes: Seeds for Growth", *Current Opinion in Biotechnology*, vol. 16, pp. 147-153 (2005).

Verslues et al., "Mutation of SAD2, an Importin β-Domain Protein in *Arabidopsis*, Alters Abscisic Acid Sensitivity", *The Plant Journal*, vol. 47, pp. 776-787 (2006).

Wagner et al. "Splayed, a Novel SWI/SNF ATPase Homolog, Controls Reproductive Development in *Arabidopsis*", *Current Biology*, vol. 12, pp. 85-96 (2002).

Worrall et al., "Involvement of Sphingosine Kinase in Plant Cell Signaling", *The Plant Journal*, vol. 56, pp. 64-72 (2008).

\* cited by examiner

PLANTS HAVING ENHANCED YIELD-RELATED TRAITS AND A METHOD FOR MAKING THE SAME

RELATED APPLICATIONS

This application is a national stage application (under 35 U.S.C. §371) of PCT/EP2009/061226, filed Aug. 31, 2009, which claims benefit of U.S. Provisional Application 61/190,543, filed Aug. 29, 2008.

The Sequence Listing associated with this application is filed in electronic format via EFS-Web and hereby incorporated by reference into the specification in its entirety. The name of the text file containing the Sequence Listing is Sequence_Listing_32279_00011. The size of the text file is 2031 KB, and the text file was created on Feb. 27, 2014.

The present invention relates generally to the field of molecular biology and concerns a method for enhancing yield-related traits in plants by modulating expression in a plant of one or more nucleic acid(s) encoding at least two iSYT (interactor of SYT-synovial sarcoma translocation-) polypeptides. The present invention also concerns plants having modulated expression of a nucleic acid encoding at least two iSYT polypeptides, which plants have enhanced yield-related traits relative to corresponding wild type plants or other control plants. The invention also provides hitherto unknown nucleic acids encoding at least two iSYT polypeptides, and constructs comprising the same, useful in performing the methods of the invention. The invention also provides constructs useful in the methods of the invention. Furthermore the present invention also relates to an iSYT-based protein complex. It further relates to the use of the complex to promote plant growth, and to a method for stimulating the complex formation, by overexpressing at least two members of the complex.

The ever-increasing world population and the dwindling supply of arable land available for agriculture fuels research towards increasing the efficiency of agriculture. Conventional means for crop and horticultural improvements utilise selective breeding techniques to identify plants having desirable characteristics. However, such selective breeding techniques have several drawbacks, namely that these techniques are typically labour intensive and result in plants that often contain heterogeneous genetic components that may not always result in the desirable trait being passed on from parent plants. Advances in molecular biology have allowed mankind to modify the germplasm of animals and plants. Genetic engineering of plants entails the isolation and manipulation of genetic material (typically in the form of DNA or RNA) and the subsequent introduction of that genetic material into a plant. Such technology has the capacity to deliver crops or plants having various improved economic, agronomic or horticultural traits.

The demand for more plant derived products has spectacularly increased. In the near future the challenge for agriculture will be to fulfill the growing demands for feed and food in a sustainable manner. Moreover plants start to play an important role as energy sources. To cope with these major challenges, a profound increase in plant yield will have to be achieved. Biomass production is a multi-factorial system in which a plethora of processes are fed into the activity of meristems that give rise to new cells, tissues, and organs. Although a considerable amount of research on yield performance is being performed little is known about the molecular networks underpinning yield (Van Camp, 2005). Many genes have been described in *Arabidopsis thaliana* that, when mutated or ectopically expressed, result in the formation of larger structures, such as leaves or roots. These so-called "intrinsic yield genes" are involved in many different processes whose interrelationship is mostly unknown.

A trait of particular economic interest is increased yield. Yield is normally defined as the measurable produce of economic value from a crop. This may be defined in terms of quantity and/or quality. Yield is directly dependent on several factors, for example, the number and size of the organs, plant architecture (for example, the number of branches), seed production, leaf senescence and more. Root development, nutrient uptake, stress tolerance and early vigour may also be important factors in determining yield. Optimizing the above-mentioned factors may therefore contribute to increasing crop yield.

Seed yield is a particularly important trait, since the seeds of many plants are important for human and animal nutrition. Crops such as corn, rice, wheat, canola and soybean account for over half the total human caloric intake, whether through direct consumption of the seeds themselves or through consumption of meat products raised on processed seeds. They are also a source of sugars, oils and many kinds of metabolites used in industrial processes. Seeds contain an embryo (the source of new shoots and roots) and an endosperm (the source of nutrients for embryo growth during germination and during early growth of seedlings). The development of a seed involves many genes, and requires the transfer of metabolites from the roots, leaves and stems into the growing seed. The endosperm, in particular, assimilates the metabolic precursors of carbohydrates, oils and proteins and synthesizes them into storage macromolecules to fill out the grain.

Another important trait for many crops is early vigour. Improving early vigour is an important objective of modern rice breeding programs in both temperate and tropical rice cultivars. Long roots are important for proper soil anchorage in water-seeded rice. Where rice is sown directly into flooded fields, and where plants must emerge rapidly through water, longer shoots are associated with vigour. Where drill-seeding is practiced, longer mesocotyls and coleoptiles are important for good seedling emergence. The ability to engineer early vigour into plants would be of great importance in agriculture. For example, poor early vigour has been a limitation to the introduction of maize (*Zea mays* L.) hybrids based on Corn Belt germplasm in the European Atlantic.

A further important trait is that of improved abiotic stress tolerance. Abiotic stress is a primary cause of crop loss worldwide, reducing average yields for most major crop plants by more than 50% (Wang et al., Planta 218, 1-14, 2003). Abiotic stresses may be caused by drought, salinity, extremes of temperature, chemical toxicity and oxidative stress. The ability to improve plant tolerance to abiotic stress would be of great economic advantage to farmers worldwide and would allow for the cultivation of crops during adverse conditions and in territories where cultivation of crops may not otherwise be possible.

Crop yield may therefore be increased by optimising one of the above-mentioned factors. Depending on the end use, the modification of certain yield traits may be favoured over others. For example for applications such as forage or wood production, or bio-fuel resource, an increase in the vegetative parts of a plant may be desirable, and for applications such as flour, starch or oil production, an increase in seed parameters may be particularly desirable. Even amongst the seed parameters, some may be favoured over others, depending on the application. Various mechanisms may contribute to increasing seed yield, whether that is in the form of increased seed size or increased seed number.

One approach to increasing yield (seed yield and/or biomass) in plants may be through modification of the inherent growth mechanisms of a plant, such as the cell cycle or various signalling pathways involved in plant growth or in defense mechanisms.

It has now been found that various yield-related traits may be enhanced in plants by modulating expression in a plant of one or more nucleic acid(s) encoding at least two iSYT polypeptides, selected from the group consisting of any of the polypeptides of Table A, homologues thereof, and fusions of the same.

BACKGROUND

One of the abovementioned "intrinsic yield genes", AN3 (also known as GIF1 and herein also refer to as SYT— synovial sarcoma translocation polypeptide), was identified in search of GRF (growth regulating factor) interactors (Kim and Kende, 2004) and by analysis of narrow-leaf *Arabidopsis* mutants (Horiguchi et al., 2005). SYT is a homolog of the human SYT (synovial sarcoma translocation) protein and is encoded by a small gene family in the *Arabidopsis* genome. SYT is a transcription co-activator whose biological function, despite the implication of its chromosomal translocation in tumorigenesis, is still unclear (Clark et al., 1994; de Bruijn et al., 1996). Using the yeast GAL4 system, SYT was shown to possess transactivation activity (Kim and Kende, 2004). This together with yeast two-hybrid and in vitro binding assays demonstrating interaction of SYT with several GRFs (Kim and Kende, 2004; Horiguchi et al., 2005), suggests a role of SYT as transcription co-activator of GRFs. GRF (growth regulating factor) genes occur in the genomes of all seed plants thus far examined and encode putative transcription factors that play a regulatory role in growth and development of leaves (Kim et al., 2003). In support of a GRF and SYT transcription activator and co-activator complex, grf and SYT mutants display similar phenotypes, and combinations of grf and SYT mutations showed a cooperative effect (Kim and Kende, 2004). The SYT mutant narrow-leaf phenotype is shown to result of a reduction in cell numbers. Moreover, ectopic expression of SYT resulted in transgenic plants with larger leaves consisting of more cells, indicating that SYT controls both cell number and organ size (Horiguchi et al., 2005). Although the function of SYT in plant growth regulation is not known, these results show that SYT fulfills the requirements of an "intrinsic yield gene".

In our ambition to decipher the molecular network underpinning yield enhancement mechanism a genome-wide protein centred approach was undertaken to study SYT interacting proteins in *Arabidopsis thaliana* cell suspension cultures. The tandem affinity purification (TAP) technology combined with mass spectrometry (MS) based protein identification resulted in the isolation and identification of SYT interacting proteins that may function in the regulation of plant growth (iSYT). Surprisingly, we isolated several proteins belonging to multiprotein complexes. Moreover, many interactors were previously completely uncharacterized. Reports on few of the SYT interactors show that they are implicated in several developmental processes (Wagner & Meyerowitz, 2002; Meagher et al., 2005; Sarnowski et al., 2005; Hurtado et al., 2006; Kwon et al., 2006) but so far none of the identified (iSYT genes have been associated with stimulation of plant growth. Further surprising no specific combination of iSYT polypeptides useful to enhance yield related traits has previously been described.

SUMMARY

Surprisingly, it has now been found that modulating expression in a plant of one or more nucleic acid(s) encoding at least two iSYT polypeptides wherein said iSYT polypeptide is selected from the group consisting of any of the polypeptides of Table A, homologues thereof, and fusions of the same, promotes plant growth and gives plants having enhanced yield-related traits relative to control plants, According one embodiment, there is provided a method for enhancing yield-related traits in plants relative to control plants, comprising modulating expression in a plant of one or more nucleic acid(s) encoding at least two iSYT polypeptides wherein said iSYT polypeptide is selected from the group consisting of any of the polypeptides of Table A, homologues thereof, and fusions of the same.

DEFINITIONS

Polypeptide(s)/Protein(s)

The terms "polypeptide" and "protein" are used interchangeably herein and refer to amino acids in a polymeric form of any length, linked together by peptide bonds.
Polynucleotide(s)/Nucleic Acid(s)/Nucleic Acid Sequence(s)/Nucleotide Sequence(s)

The terms "polynucleotide(s)", "nucleic acid sequence(s)", "nucleotide sequence(s)", "nucleic acid(s)", "nucleic acid molecule" are used interchangeably herein and refer to nucleotides, either ribonucleotides or deoxyribonucleotides or a combination of both, in a polymeric unbranched form of any length.
Recombinant DNA "Recombinant DNA" means a DNA molecule that is made by combination of two otherwise separated segments of DNA, e.g., by chemical synthesis or by the manipulation of isolated segments of nucleic acids by genetic engineering techniques. Recombinant DNA can include exogenous DNA or simply a manipulated native DNA. Recombinant DNA for expressing a protein in a plant is typically provided as an expression cassette which has a promoter that is active in plant cells operably linked to DNA encoding a protein of interest.
Homologue(s)

"Homologues" of a protein encompass peptides, oligopeptides, polypeptides, proteins and enzymes having amino acid substitutions, deletions and/or insertions relative to the unmodified protein in question and having similar biological and functional activity as the unmodified protein from which they are derived.

A deletion refers to removal of one or more amino acids from a protein.

An insertion refers to one or more amino acid residues being introduced into a predetermined site in a protein. Insertions may comprise N-terminal and/or C-terminal fusions as well as intra-sequence insertions of single or multiple amino acids. Generally, insertions within the amino acid sequence will be smaller than N- or C-terminal fusions, of the order of about 1 to 10 residues. Examples of N- or C-terminal fusion proteins or peptides include the binding domain or activation domain of a transcriptional activator as used in the yeast two-hybrid system, phage coat proteins, (histidine)-6-tag, glutathione S-transferase-tag, protein A, maltose-binding protein, dihydrofolate reductase, Tag·100 epitope, c-myc epitope, FLAG®-epitope, lacZ, CMP (calmodulin-binding peptide), HA epitope, protein C epitope and VSV epitope.

A substitution refers to replacement of amino acids of the protein with other amino acids having similar properties (such as similar hydrophobicity, hydrophilicity, antigenicity, propensity to form or break α-helical structures or β-sheet structures). Amino acid substitutions are typically of single residues, but may be clustered depending upon functional constraints placed upon the polypeptide; insertions will usually be of the order of about 1 to 10 amino acid residues. The amino acid substitutions are preferably conservative amino acid substitutions. Conservative substitution tables are well known in the art (see for example Creighton (1984) Proteins. W.H. Freeman and Company (Eds) and Table 1 below).

TABLE 1

Examples of conserved amino acid substitutions

| Residue | Conservative Substitutions |
| --- | --- |
| Ala | Ser |
| Arg | Lys |
| Asn | Gln; His |
| Asp | Glu |
| Gln | Asn |
| Cys | Ser |
| Glu | Asp |
| Gly | Pro |
| His | Asn; Gln |
| Ile | Leu, Val |
| Leu | Ile; Val |
| Lys | Arg; Gln |
| Met | Leu; Ile |
| Phe | Met; Leu; Tyr |
| Ser | Thr; Gly |
| Thr | Ser; Val |
| Trp | Tyr |
| Tyr | Trp; Phe |
| Val | Ile; Leu |

Amino acid substitutions, deletions and/or insertions may readily be made using peptide synthetic techniques well known in the art, such as solid phase peptide synthesis and the like, or by recombinant DNA manipulation. Methods for the manipulation of DNA sequences to produce substitution, insertion or deletion variants of a protein are well known in the art. For example, techniques for making substitution mutations at predetermined sites in DNA are well known to those skilled in the art and include M13 mutagenesis, T7-Gen in vitro mutagenesis (USB, Cleveland, Ohio), QuickChange Site Directed mutagenesis (Stratagene, San Diego, Calif.), PCR-mediated site-directed mutagenesis or other site-directed mutagenesis protocols.

Derivatives

"Derivatives" include peptides, oligopeptides, polypeptides which may, compared to the amino acid sequence of the naturally-occurring form of the protein, such as the protein of interest, comprise substitutions of amino acids with non-naturally occurring amino acid residues, or additions of non-naturally occurring amino acid residues. "Derivatives" of a protein also encompass peptides, oligopeptides, polypeptides which comprise naturally occurring altered (glycosylated, acylated, prenylated, phosphorylated, myristoylated, sulphated etc.) or non-naturally altered amino acid residues compared to the amino acid sequence of a naturally-occurring form of the polypeptide. A derivative may also comprise one or more non-amino acid substituents or additions compared to the amino acid sequence from which it is derived, for example a reporter molecule or other ligand, covalently or non-covalently bound to the amino acid sequence, such as a reporter molecule which is bound to facilitate its detection, and non-naturally occurring amino acid residues relative to the amino acid sequence of a naturally-occurring protein. Furthermore, "derivatives" also include fusions of the naturally-occurring form of the protein with tagging peptides such as FLAG, HIS6 or thioredoxin (for a review of tagging peptides, see Terpe, Appl. Microbiol. Biotechnol. 60, 523-533, 2003).

Orthologue(s)/Paralogue(s)

Orthologues and paralogues encompass evolutionary concepts used to describe the ancestral relationships of genes. Paralogues are genes within the same species that have originated through duplication of an ancestral gene; orthologues are genes from different organisms that have originated through speciation, and are also derived from a common ancestral gene.

Domain, Motif/Consensus Sequence/Signature

The term "domain" refers to a set of amino acids conserved at specific positions along an alignment of sequences of evolutionarily related proteins. While amino acids at other positions can vary between homologues, amino acids that are highly conserved at specific positions indicate amino acids that are likely essential in the structure, stability or function of a protein. Identified by their high degree of conservation in aligned sequences of a family of protein homologues, they can be used as identifiers to determine if any polypeptide in question belongs to a previously identified polypeptide family.

The term "motif" or "consensus sequence" or "signature" refers to a short conserved region in the sequence of evolutionarily related proteins. Motifs are frequently highly conserved parts of domains, but may also include only part of the domain, or be located outside of conserved domain (if all of the amino acids of the motif fall outside of a defined domain).

Specialist databases exist for the identification of domains, for example, SMART (Schultz et al. (1998) Proc. Natl. Acad. Sci. USA 95, 5857-5864; Letunic et al. (2002) Nucleic Acids Res 30, 242-244), InterPro (Mulder et al., (2003) Nucl. Acids. Res. 31, 315-318), Prosite (Bucher and Bairoch (1994), A generalized profile syntax for biomolecular sequences motifs and its function in automatic sequence interpretation. (In) ISMB-94; Proceedings 2nd International Conference on Intelligent Systems for Molecular Biology. Altman R., Brutlag D., Karp P., Lathrop R., Searls D., Eds., pp 53-61, AAAI Press, Menlo Park; Hulo et al., Nucl. Acids. Res. 32:D134-D137, (2004)), or Pfam (Bateman et al., Nucleic Acids Research 30(1): 276-280 (2002)). A set of tools for in silico analysis of protein sequences is available on the ExPASy proteomics server (Swiss Institute of Bioinformatics (Gasteiger et al., ExPASy: the proteomics server for in-depth protein knowledge and analysis, Nucleic Acids Res. 31:3784-3788 (2003)). Domains or motifs may also be identified using routine techniques, such as by sequence alignment.

Methods for the alignment of sequences for comparison are well known in the art, such methods include GAP, BESTFIT, BLAST, FASTA and TFASTA. GAP uses the algorithm of Needleman and Wunsch ((1970) J Mol Biol 48: 443-453) to find the global (i.e. spanning the complete sequences) alignment of two sequences that maximizes the number of matches and minimizes the number of gaps. The BLAST algorithm (Altschul et al. (1990) J Mol Biol 215: 403-10) calculates percent sequence identity and performs a statistical analysis of the similarity between the two sequences. The software for performing BLAST analysis is publicly available through the National Centre for Biotechnology Information (NCBI). Homologues may readily be identified using, for example, the ClustalW multiple sequence alignment algorithm (version 1.83), with the default pairwise alignment parameters, and a scoring method in percentage. Global percentages of similarity and identity may also be determined using one of the methods available in the MatGAT software package (Campanella et al., BMC Bioinformatics. 2003 Jul. 10; 4:29. MatGAT: an application that generates similarity/identity matrices using protein or DNA sequences.). Minor manual editing may be performed to optimise alignment between conserved motifs, as would be apparent to a person skilled in the art. Furthermore, instead of using full-length sequences for the identification of homologues, specific domains may also be used. The sequence identity values may be determined over the entire nucleic acid or amino acid sequence or over selected domains or conserved motif(s), using the programs mentioned above using the default parameters. For local alignments, the Smith-Waterman algorithm is particularly useful (Smith T F, Waterman M S (1981) J. Mol. Biol. 147(1); 195-7).

Reciprocal BLAST

Typically, this involves a first BLAST involving BLASTing a query sequence (for example using any of the sequences listed in Table A of the Examples section) against any sequence database, such as the publicly available NCBI database. BLASTN or TBLASTX (using standard default values) are generally used when starting from a nucleotide sequence, and BLASTP or TBLASTN (using standard default values) when starting from a protein sequence. The BLAST results may optionally be filtered. The full-length sequences of either the filtered results or non-filtered results are then BLASTed back (second BLAST) against sequences from the organism from which the query sequence is derived. The results of the first and second BLASTs are then compared. A paralogue is identified if a high-ranking hit from the first blast is from the same species as from which the query sequence is derived, a BLAST back then ideally results in the query sequence amongst the highest hits; an orthologue is identified if a high-ranking hit in the first BLAST is not from the same species as from which the query sequence is derived, and preferably results upon BLAST back in the query sequence being among the highest hits.

High-ranking hits are those having a low E-value. The lower the E-value, the more significant the score (or in other words the lower the chance that the hit was found by chance). Computation of the E-value is well known in the art. In addition to E-values, comparisons are also scored by percentage identity. Percentage identity refers to the number of identical nucleotides (or amino acids) between the two compared nucleic acid (or polypeptide) sequences over a particular length. In the case of large families, ClustalW may be used, followed by a neighbour joining tree, to help visualize clustering of related genes and to identify orthologues and paralogues.

Hybridisation

The term "hybridisation" as defined herein is a process wherein substantially homologous complementary nucleotide sequences anneal to each other. The hybridisation process can occur entirely in solution, i.e. both complementary nucleic acids are in solution. The hybridisation process can also occur with one of the complementary nucleic acids immobilised to a matrix such as magnetic beads, Sepharose beads or any other resin. The hybridisation process can furthermore occur with one of the complementary nucleic acids immobilised to a solid support such as a nitro-cellulose or nylon membrane or immobilised by e.g. photolithography to, for example, a siliceous glass support (the latter known as nucleic acid arrays or microarrays or as nucleic acid chips). In order to allow hybridisation to occur, the nucleic acid molecules are generally thermally or chemically denatured to melt a double strand into two single strands and/or to remove hairpins or other secondary structures from single stranded nucleic acids.

The term "stringency" refers to the conditions under which a hybridisation takes place. The stringency of hybridisation is influenced by conditions such as temperature, salt concentration, ionic strength and hybridisation buffer composition. Generally, low stringency conditions are selected to be about 30° C. lower than the thermal melting point ($T_m$) for the specific sequence at a defined ionic strength and pH. Medium stringency conditions are when the temperature is 20° C. below $T_m$, and high stringency conditions are when the temperature is 10° C. below $T_m$. High stringency hybridisation conditions are typically used for isolating hybridising sequences that have high sequence similarity to the target nucleic acid sequence. However, nucleic acids may deviate in sequence and still encode a substantially identical polypeptide, due to the degeneracy of the genetic code. Therefore medium stringency hybridisation conditions may sometimes be needed to identify such nucleic acid molecules.

The Tm is the temperature under defined ionic strength and pH, at which 50% of the target sequence hybridises to a perfectly matched probe. The $T_m$ is dependent upon the solution conditions and the base composition and length of the probe. For example, longer sequences hybridise specifically at higher temperatures. The maximum rate of hybridisation is obtained from about 16° C. up to 32° C. below $T_m$. The presence of monovalent cations in the hybridisation solution reduce the electrostatic repulsion between the two nucleic acid strands thereby promoting hybrid formation; this effect is visible for sodium concentrations of up to 0.4M (for higher concentrations, this effect may be ignored). Formamide reduces the melting temperature of DNA-DNA and DNA-RNA duplexes with 0.6 to 0.7° C. for each percent formamide, and addition of 50% formamide allows hybridisation to be performed at 30 to 45° C., though the rate of hybridisation will be lowered. Base pair mismatches reduce the hybridisation rate and the thermal stability of the duplexes. On average and for large probes, the Tm decreases about 1° C. per % base mismatch. The Tm may be calculated using the following equations, depending on the types of hybrids:

1) DNA-DNA hybrids (Meinkoth and Wahl, Anal. Biochem., 138: 267-284, 1984):

$$T_m = 81.5° C. + 16.6 \times \log_{10}[Na]^a + 0.41 \times \%[G/C^b] - 500 \times [L^c]^{-1} - 0.61 \times \% \text{ formamide}$$

2) DNA-RNA or RNA-RNA hybrids:

$$T_m = 79.8 + 18.5(\log_{10}[Na^+]a) + 0.58(\% G/C^b) + 11.8(\% G/C^b)^2 - 820/L^c$$

3) oligo-DNA or oligo-RNAs hybrids:
   For <20 nucleotides: $T_m = 2 (I_n)$
   For 20-35 nucleotides: $T_m = 22 + 1.46 (I_n)$

[a] or for other monovalent cation, but only accurate in the 0.01-0.4 M range.
[b] only accurate for % GC in the 30% to 75% range.
[c] L=length of duplex in base pairs.
[d] oligo, oligonucleotide; $I_n$, =effective length of primer=2× (no. of G/C)+(no. of A/T).

Non-specific binding may be controlled using any one of a number of known techniques such as, for example, blocking the membrane with protein containing solutions, additions of heterologous RNA, DNA, and SDS to the hybridisation buffer, and treatment with Rnase. For non-homologous probes, a series of hybridizations may be performed by varying one of (i) progressively lowering the annealing temperature (for example from 68° C. to 42° C.) or (ii) progressively lowering the formamide concentration (for example from 50% to 0%). The skilled artisan is aware of various parameters which may be altered during hybridisation and which will either maintain or change the stringency conditions.

Besides the hybridisation conditions, specificity of hybridisation typically also depends on the function of post-hybridisation washes. To remove background resulting from non-specific hybridisation, samples are washed with dilute salt solutions. Critical factors of such washes include the ionic strength and temperature of the final wash solution: the lower the salt concentration and the higher the wash temperature, the higher the stringency of the wash. Wash conditions are typically performed at or below hybridisation stringency. A positive hybridisation gives a signal that is at least twice of that of the background. Generally, suitable stringent conditions for nucleic acid hybridisation assays or gene amplification detection procedures are as set forth above. More or less stringent conditions may also be selected. The skilled artisan is aware of various parameters which may be altered during washing and which will either maintain or change the stringency conditions.

For example, typical high stringency hybridisation conditions for DNA hybrids longer than 50 nucleotides encompass hybridisation at 65° C. in 1×SSC or at 42° C. in 1×SSC and 50% formamide, followed by washing at 65° C. in 0.3×SSC. Examples of medium stringency hybridisation conditions for DNA hybrids longer than 50 nucleotides encompass hybridisation at 50° C. in 4×SSC or at 40° C. in 6×SSC and 50% formamide, followed by washing at 50° C. in 2×SSC. The length of the hybrid is the anticipated length for the hybridising nucleic acid. When nucleic acids of known sequence are hybridised, the hybrid length may be determined by aligning the sequences and identifying the conserved regions described herein. 1×SSC is 0.15M NaCl and 15 mM sodium citrate; the hybridisation solution and wash solutions may additionally include 5×Denhardt's reagent, 0.5-1.0% SDS, 100 µg/ml denatured, fragmented salmon sperm DNA, 0.5% sodium pyrophosphate.

For the purposes of defining the level of stringency, reference can be made to Sambrook et al. (2001) Molecular Cloning: a laboratory manual, 3rd Edition, Cold Spring Harbor Laboratory Press, CSH, New York or to Current Protocols in Molecular Biology, John Wiley & Sons, N.Y. (1989 and yearly updates).

Splice Variant

The term "splice variant" as used herein encompasses variants of a nucleic acid sequence in which selected introns and/or exons have been excised, replaced, displaced or added, or in which introns have been shortened or lengthened. Such variants will be ones in which the biological activity of the protein is substantially retained; this may be achieved by selectively retaining functional segments of the protein. Such splice variants may be found in nature or may be manmade. Methods for predicting and isolating such splice variants are well known in the art (see for example Foissac and Schiex (2005) BMC Bioinformatics 6: 25).

Allelic Variant

Alleles or allelic variants are alternative forms of a given gene, located at the same chromosomal position. Allelic variants encompass Single Nucleotide Polymorphisms (SNPs), as well as Small Insertion/Deletion Polymorphisms (INDELs). The size of INDELs is usually less than 100 bp. SNPs and INDELs form the largest set of sequence variants in naturally occurring polymorphic strains of most organisms.

Endogenous Gene

Reference herein to an "endogenous" gene not only refers to the gene in question as found in a plant in its natural form (i.e., without there being any human intervention), but also refers to that same gene (or a substantially homologous nucleic acid/gene) in an isolated form subsequently (re)introduced into a plant (a transgene). For example, a transgenic plant containing such a transgene may encounter a substantial reduction of the transgene expression and/or substantial reduction of expression of the endogenous gene. The isolated gene may be isolated from an organism or may be manmade, for example by chemical synthesis.

Gene Shuffling/Directed Evolution

Gene shuffling or directed evolution consists of iterations of DNA shuffling followed by appropriate screening and/or selection to generate variants of nucleic acids or portions thereof encoding proteins having a modified biological activity (Castle et al., (2004) Science 304(5674): 1151-4; U.S. Pat. Nos. 5,811,238 and 6,395,547).

Construct

Additional regulatory elements may include transcriptional as well as translational enhancers. Those skilled in the art will be aware of terminator and enhancer sequences that may be suitable for use in performing the invention. An intron sequence may also be added to the 5' untranslated region (UTR) or in the coding sequence to increase the amount of the mature message that accumulates in the cytosol, as described in the definitions section. Other control sequences (besides promoter, enhancer, silencer, intron sequences, 3'UTR and/or 5'UTR regions) may be protein and/or RNA stabilizing elements. Such sequences would be known or may readily be obtained by a person skilled in the art.

The genetic constructs of the invention may further include an origin of replication sequence that is required for maintenance and/or replication in a specific cell type. One example is when a genetic construct is required to be maintained in a bacterial cell as an episomal genetic element (e.g. plasmid or cosmid molecule). Preferred origins of replication include, but are not limited to, the f1-ori and colE1.

For the detection of the successful transfer of the nucleic acid sequences as used in the methods of the invention and/or selection of transgenic plants comprising these nucleic acids, it is advantageous to use marker genes (or reporter genes). Therefore, the genetic construct may optionally comprise a selectable marker gene. Selectable markers are described in more detail in the "definitions" section herein. The marker genes may be removed or excised from the transgenic cell once they are no longer needed. Techniques for marker removal are known in the art, useful techniques are described above in the definitions section.

Regulatory Element/Control Sequence/Promoter

The terms "regulatory element", "control sequence" and "promoter" are all used interchangeably herein and are to be taken in a broad context to refer to regulatory nucleic acid sequences capable of effecting expression of the sequences to which they are ligated. The term "promoter" typically refers to a nucleic acid control sequence located upstream from the transcriptional start of a gene and which is involved in recognising and binding of RNA polymerase and other proteins, thereby directing transcription of an operably linked nucleic acid. Encompassed by the aforementioned terms are transcriptional regulatory sequences derived from a classical eukaryotic genomic gene (including the TATA box which is required for accurate transcription initiation, with or without a CCAAT box sequence) and additional regulatory elements (i.e. upstream activating sequences, enhancers and silencers) which alter gene expression in response to developmental and/or external stimuli, or in a tissue-specific manner. Also included within the term is a transcriptional regulatory sequence of a classical prokaryotic gene, in which case it may include a −35 box sequence and/or −10 box transcriptional regulatory sequences. The term "regulatory element" also encompasses a synthetic fusion molecule or derivative that confers, activates or enhances expression of a nucleic acid molecule in a cell, tissue or organ.

A "plant promoter" comprises regulatory elements, which mediate the expression of a coding sequence segment in plant cells. Accordingly, a plant promoter need not be of plant origin, but may originate from viruses or micro-organisms, for example from viruses which attack plant cells. The "plant promoter" can also originate from a plant cell, e.g. from the plant which is transformed with the nucleic acid sequence to be expressed in the inventive process and described herein. This also applies to other "plant" regulatory signals, such as "plant" terminators. The promoters upstream of the nucleotide sequences useful in the methods of the present invention can be modified by one or more nucleotide substitution(s), insertion(s) and/or deletion(s) without interfering with the functionality or activity of either the promoters, the open reading frame (ORF) or the 3'-regulatory region such as terminators or other 3' regulatory regions which are located away from the ORF. It is furthermore possible that the activity of the promoters is increased by modification of their sequence, or that they are replaced completely by more active promoters, even promoters from heterologous organisms. For expression in plants, the nucleic acid molecule must, as described above, be linked operably to or comprise a suitable promoter which expresses the gene at the right point in time and with the required spatial expression pattern.

For the identification of functionally equivalent promoters, the promoter strength and/or expression pattern of a candidate promoter may be analysed for example by operably linking the promoter to a reporter gene and assaying the expression level and pattern of the reporter gene in various tissues of the plant. Suitable well-known reporter genes include for example beta-glucuronidase or beta-galactosidase. The promoter activity is assayed by measuring the enzymatic activity of the beta-glucuronidase or beta-galactosidase. The promoter strength and/or expression pattern may then be compared to that of a reference promoter (such as the one used in the methods of the present invention). Alternatively, promoter strength may be assayed by quantifying mRNA levels or by comparing mRNA levels of the nucleic acid used in the methods of the present invention, with mRNA levels of housekeeping genes such as 18S rRNA, using methods known in the art, such as Northern blotting with densitometric analysis of autoradiograms, quantitative real-time PCR or RT-PCR (Heid et al., 1996 Genome Methods 6: 986-994). Generally by "weak promoter" is intended a promoter that drives expression of a coding sequence at a low level. By "low level" is intended at levels of about 1/10,000 transcripts to about 1/100,000 transcripts, to about 1/500, 0000 transcripts per cell. Conversely, a "strong promoter" drives expression of a coding sequence at high level, or at about 1/10 transcripts to about 1/100 transcripts to about 1/1000 transcripts per cell. Generally, by "medium strength promoter" is intended a promoter that drives expression of a coding sequence at a lower level than a strong promoter, in particular at a level that is in all instances below that obtained when under the control of a 35S CaMV promoter.

Operably Linked

The term "operably linked" as used herein refers to a functional linkage between the promoter sequence and the gene of interest, such that the promoter sequence is able to initiate transcription of the gene of interest.

Constitutive Promoter

A "constitutive promoter" refers to a promoter that is transcriptionally active during most, but not necessarily all, phases of growth and development and under most environmental conditions, in at least one cell, tissue or organ. Table 2a below gives examples of constitutive promoters.

TABLE 2a

Examples of constitutive promoters

| Gene Source | Reference |
| --- | --- |
| Actin | McElroy et al, Plant Cell, 2: 163-171, 1990 |
| HMGP | WO 2004/070039 |
| CAMV 35S | Odell et al, Nature, 313: 810-812, 1985 |
| CaMV 19S | Nilsson et al., Physiol. Plant. 100: 456-462, 1997 |
| GOS2 | de Pater et al, Plant J Nov; 2(6): 837-44, 1992, WO 2004/065596 |
| Ubiquitin | Christensen et al, Plant Mol. Biol. 18: 675-689, 1992 |
| Rice cyclophilin | Buchholz et al, Plant Mol Biol. 25(5): 837-43, 1994 |
| Maize H3 histone | Lepetit et al, Mol. Gen. Genet. 231: 276-285, 1992 |
| Alfalfa H3 histone | Wu et al. Plant Mol. Biol. 11: 641-649, 1988 |
| Actin 2 | An et al, Plant J. 10(1); 107-121, 1996 |
| 34S FMV | Sanger et al., Plant. Mol. Biol., 14, 1990: 433-443 |
| Rubisco small subunit | U.S. Pat. No. 4,962,028 |
| OCS | Leisner (1988) Proc Natl Acad Sci USA 85(5): 2553 |
| SAD1 | Jain et al., Crop Science, 39 (6), 1999: 1696 |
| SAD2 | Jain et al., Crop Science, 39 (6), 1999: 1696 |
| nos | Shaw et al. (1984) Nucleic acid sequences Res. 12(20): 7831-7846 |
| V-ATPase | WO 01/14572 |
| Super promoter | WO 95/14098 |
| G-box proteins | WO 94/12015 |

Ubiquitous Promoter

A ubiquitous promoter is active in substantially all tissues or cells of an organism.

Developmentally-Regulated Promoter

A developmentally-regulated promoter is active during certain developmental stages or in parts of the plant that undergo developmental changes.

Inducible Promoter

An inducible promoter has induced or increased transcription initiation in response to a chemical (for a review see Gatz 1997, Annu. Rev. Plant Physiol. Plant Mol. Biol., 48:89-108), environmental or physical stimulus, or may be "stress-inducible", i.e. activated when a plant is exposed to various stress conditions, or a "pathogen-inducible" i.e. activated when a plant is exposed to exposure to various pathogens.

Organ-Specific/Tissue-Specific Promoter

An organ-specific or tissue-specific promoter is one that is capable of preferentially initiating transcription in certain organs or tissues, such as the leaves, roots, seed tissue etc. For example, a "root-specific promoter" is a promoter that is transcriptionally active predominantly in plant roots, substantially to the exclusion of any other parts of a plant, whilst still allowing for any leaky expression in these other plant parts. Promoters able to initiate transcription in certain cells only are referred to herein as "cell-specific".

Examples of root-specific promoters are listed in Table 2b below:

TABLE 2b

Examples of root-specific promoters

| Gene Source | Reference |
| --- | --- |
| RCc3 | Plant Mol Biol. 1995 January; 27(2): 237-48 |
| Arabidopsis PHT1 | Kovama et al., 2005; Mudge et al. (2002, Plant J. 31: 341) |
| Medicago phosphate transporter | Xiao et al., 2006 |
| Arabidopsis Pyk10 | Nitz et al. (2001) Plant Sci 161(2): 337-346 |
| root-expressible genes | Tingey et al., EMBO J. 6: 1, 1987. |
| tobacco auxin-inducible gene | Van der Zaal et al., Mol. Plant Mol. Biol. 16, 983, 1991. |

TABLE 2b-continued

Examples of root-specific promoters

| Gene Source | Reference |
|---|---|
| β-tubulin | Oppenheimer, et al., Gene 63: 87, 1988. |
| tobacco root-specific genes | Conkling, et al., Plant Physiol. 93: 1203, 1990. |
| B. napus G1-3b gene | U.S. Pat. No. 5,401,836 |
| SbPRP1 | Suzuki et al., Plant Mol. Biol. 21: 109-119, 1993. |
| LRX1 | Baumberger et al. 2001, Genes & Dev. 15: 1128 |
| BTG-26 Brassica napus | US 20050044585 |
| LeAMT1 (tomato) | Lauter et al. (1996, PNAS 3: 8139) |
| The LeNRT1-1 (tomato) | Lauter et al. (1996, PNAS 3: 8139) |
| class I patatin gene (potato) | Liu et al., Plant Mol. Biol. 153: 386-395, 1991. |
| KDC1 (Daucus carota) | Downey et al. (2000, J. Biol. Chem. 275: 39420) |
| TobRB7 gene | W Song (1997) PhD Thesis, North Carolina State University, Raleigh, NC USA |
| OsRAB5a (rice) | Wang et al. 2002, Plant Sci. 163: 273 |
| ALF5 (Arabidopsis) | Diener et al. (2001, Plant Cell 13: 1625) |
| NRT2; 1Np (N. plumbaginifolia) | Quesada et al. (1997, Plant Mol. Biol. 34: 265) |

A seed-specific promoter is transcriptionally active predominantly in seed tissue, but not necessarily exclusively in seed tissue (in cases of leaky expression). The seed-specific promoter may be active during seed development and/or during germination. The seed specific promoter may be endosperm/aleurone/embryo specific. Examples of seed-specific promoters (endosperm/aleurone/embryo specific) are shown in Table 2c to Table 2f below. Further examples of seed-specific promoters are given in Qing Qu and Takaiwa (Plant Biotechnol. J. 2, 113-125, 2004), which disclosure is incorporated by reference herein as if fully set forth.

TABLE 2c

Examples of seed-specific promoters

| Gene source | Reference |
|---|---|
| seed-specific genes | Simon et al., Plant Mol. Biol. 5: 191, 1985; Scofield et al., J. Biol. Chem. 262: 12202, 1987.; Baszczynski et al., Plant Mol. Biol. 14: 633, 1990. |
| Brazil Nut albumin | Pearson et al., Plant Mol. Biol. 18: 235-245, 1992. |
| legumin | Ellis et al., Plant Mol. Biol. 10: 203-214, 1988. |
| glutelin (rice) | Takaiwa et al., Mol. Gen. Genet. 208: 15-22, 1986; Takaiwa et al., FEBS Letts. 221: 43-47, 1987. |
| zein | Matzke et al Plant Mol Biol, 14(3): 323-32 1990 |
| napA | Stalberg et al, Planta 199: 515-519, 1996. |
| wheat LMW and HMW glutenin-1 | Mol Gen Genet 216: 81-90, 1989; NAR 17: 461-2, 1989 |
| wheat SPA | Albani et al, Plant Cell, 9: 171-184, 1997 |
| wheat α, β, γ-gliadins | EMBO J. 3: 1409-15, 1984 |
| barley Itr1 promoter | Diaz et al. (1995) Mol Gen Genet 248(5): 592-8 |
| barley B1, C, D, hordein | Theor Appl Gen 98: 1253-62, 1999; Plant J 4: 343-55, 1993; Mol Gen Genet 250: 750-60, 1996 |
| barley DOF | Mena et al, The Plant Journal, 116(1): 53-62, 1998 |
| blz2 | EP99106056.7 |
| synthetic promoter | Vicente-Carbajosa et al., Plant J. 13: 629-640, 1998. |
| rice prolamin NRP33 | Wu et al, Plant Cell Physiology 39(8) 885-889, 1998 |
| rice a-globulin Glb-1 | Wu et al, Plant Cell Physiology 39(8) 885-889, 1998 |
| rice OSH1 | Sato et al, Proc. Natl. Acad. Sci. USA, 93: 8117-8122, 1996 |
| rice α-globulin REB/OHP-1 | Nakase et al. Plant Mol. Biol. 33: 513-522, 1997 |
| rice ADP-glucose pyrophosphorylase | Trans Res 6: 157-68, 1997 |

TABLE 2c-continued

Examples of seed-specific promoters

| Gene source | Reference |
|---|---|
| maize ESR gene family | Plant J 12: 235-46, 1997 |
| sorghum α-kafirin | DeRose et al., Plant Mol. Biol 32: 1029-35, 1996 |
| KNOX | Postma-Haarsma et al, Plant Mol. Biol. 39: 257-71, 1999 |
| rice oleosin | Wu et al, J. Biochem. 123: 386, 1998 |
| sunflower oleosin | Cummins et al., Plant Mol. Biol. 19: 873-876, 1992 |
| PRO0117, putative rice 40S ribosomal protein | WO 2004/070039 |
| PRO0136, rice alanine aminotransferase | unpublished |
| PRO0147, trypsin inhibitor ITR1 (barley) | unpublished |
| PRO0151, rice WSI18 | WO 2004/070039 |
| PRO0175, rice RAB21 | WO 2004/070039 |
| PRO005 | WO 2004/070039 |
| PRO0095 | WO 2004/070039 |
| α-amylase (Amy32b) | Lanahan et al, Plant Cell 4: 203-211, 1992; Skriver et al, Proc Natl Acad Sci USA 88: 7266-7270, 1991 |
| cathepsin β-like gene | Cejudo et al, Plant Mol Biol 20: 849-856, 1992 |
| Barley Ltp2 | Kalla et al., Plant J. 6: 849-60, 1994 |
| Chi26 | Leah et al., Plant J. 4: 579-89, 1994 |
| Maize B-Peru | Selinger et al., Genetics 149; 1125-38, 1998 |

TABLE 2d examples of endosperm-specific promoters

| Gene source | Reference |
|---|---|
| glutelin (rice) | Takaiwa et al. (1986) Mol Gen Genet 208: 15-22; Takaiwa et al. (1987) FEBS Letts. 221: 43-47 |
| zein | Matzke et al., (1990) Plant Mol Biol 14(3): 323-32 |
| wheat LMW and HMW glutenin-1 | Colot et al. (1989) Mol Gen Genet 216: 81-90, Anderson et al. (1989) NAR 17: 461-2 |
| wheat SPA | Albani et al. (1997) Plant Cell 9: 171-184 |
| wheat gliadins | Rafalski et al. (1984) EMBO 3: 1409-15 |
| barley Itr1 promoter | Diaz et al. (1995) Mol Gen Genet 248(5): 592-8 |
| barley B1, C, D, hordein | Cho et al. (1999) Theor Appl Genet 98: 1253-62; Muller et al. (1993) Plant J 4: 343-55; Sorenson et al. (1996) Mol Gen Genet 250: 750-60 |
| barley DOF | Mena et al, (1998) Plant J 116(1): 53-62 |
| blz2 | Onate et al. (1999) J Biol Chem 274(14): 9175-82 |
| synthetic promoter | Vicente-Carbajosa et al. (1998) Plant J 13: 629-640 |
| rice prolamin NRP33 | Wu et al, (1998) Plant Cell Physiol 39(8) 885-889 |
| rice globulin Glb-1 | Wu et al. (1998) Plant Cell Physiol 39(8) 885-889 |
| rice globulin REB/OHP-1 | Nakase et al. (1997) Plant Molec Biol 33: 513-522 |
| rice ADP-glucose pyrophosphorylase | Russell et al. (1997) Trans Res 6: 157-68 |
| maize ESR gene family | Opsahl-Ferstad et al. (1997) Plant J 12: 235-46 |
| sorghum kafirin | DeRose et al. (1996) Plant Mol Biol 32: 1029-35 |

TABLE 2e

Examples of embryo specific promoters:

| Gene source | Reference |
|---|---|
| rice OSH1 | Sato et al, Proc. Natl. Acad. Sci. USA, 93: 8117-8122, 1996 |

TABLE 2e-continued

Examples of embryo specific promoters:

| Gene source | Reference |
|---|---|
| KNOX | Postma-Haarsma et al, Plant Mol. Biol. 39: 257-71, 1999 |
| PRO0151 | WO 2004/070039 |
| PRO0175 | WO 2004/070039 |
| PRO005 | WO 2004/070039 |
| PRO0095 | WO 2004/070039 |

TABLE 2f

Examples of aleurone-specific promoters:

| Gene source | Reference |
|---|---|
| α-amylase (Amy32b) | Lanahan et al, Plant Cell 4: 203-211, 1992; Skriver et al, Proc Natl Acad Sci USA 88: 7266-7270, 1991 |
| cathepsin β-like gene | Cejudo et al, Plant Mol Biol 20: 849-856, 1992 |
| Barley Ltp2 | Kalla et al., Plant J. 6: 849-60, 1994 |
| Chi26 | Leah et al., Plant J. 4: 579-89, 1994 |
| *Maize* B-Peru | Selinger et al., Genetics 149; 1125-38, 1998 |

A green tissue-specific promoter as defined herein is a promoter that is transcriptionally active predominantly in green tissue, substantially to the exclusion of any other parts of a plant, whilst still allowing for any leaky expression in these other plant parts.

Examples of green tissue-specific promoters which may be used to perform the methods of the invention are shown in Table 2 g below.

TABLE 2g

Examples of green tissue-specific promoters

| Gene | Expression | Reference |
|---|---|---|
| Maize Orthophosphate dikinase | Leaf specific | Fukayama et al., 2001 |
| *Maize* Phosphoenolpyruvate carboxylase | Leaf specific | Kausch et al., 2001 |
| Rice Phosphoenolpyruvate carboxylase | Leaf specific | Liu et al., 2003 |
| Rice small subunit Rubisco | Leaf specific | Nomura et al., 2000 |
| rice beta expansin EXBP9 | Shoot specific | WO 2004/070039 |
| Pigeonpea small subunit Rubisco | Leaf specific | Panguluri et al., 2005 |
| Pea RBCS3A | Leaf specific | |

Another example of a tissue-specific promoter is a meristem-specific promoter, which is transcriptionally active predominantly in meristematic tissue, substantially to the exclusion of any other parts of a plant, whilst still allowing for any leaky expression in these other plant parts. Examples of green meristem-specific promoters which may be used to perform the methods of the invention are shown in Table 2 h below.

TABLE 2h

Examples of meristem-specific promoters

| Gene source | Expression pattern | Reference |
|---|---|---|
| rice OSH1 | Shoot apical meristem, from embryo globular stage to seedling stage | Sato et al. (1996) Proc. Natl. Acad. Sci. USA, 93: 8117-8122 |
| Rice metallothionein | Meristem specific | BAD87835.1 |
| WAK1 & WAK 2 | Shoot and root apical meristems, and in expanding leaves and sepals | Wagner & Kohorn (2001) Plant Cell 13(2): 303-318 |

Terminator

The term "terminator" encompasses a control sequence which is a DNA sequence at the end of a transcriptional unit which signals 3' processing and polyadenylation of a primary transcript and termination of transcription. The terminator can be derived from the natural gene, from a variety of other plant genes, or from T-DNA. The terminator to be added may be derived from, for example, the nopaline synthase or octopine synthase genes, or alternatively from another plant gene, or less preferably from any other eukaryotic gene.

Selectable Marker (Gene)/Reporter Gene

"Selectable marker", "selectable marker gene" or "reporter gene" includes any gene that confers a phenotype on a cell in which it is expressed to facilitate the identification and/or selection of cells that are transfected or transformed with a nucleic acid construct of the invention. These marker genes enable the identification of a successful transfer of the nucleic acid molecules via a series of different principles. Suitable markers may be selected from markers that confer antibiotic or herbicide resistance, that introduce a new metabolic trait or that allow visual selection. Examples of selectable marker genes include genes conferring resistance to antibiotics (such as nptII that phosphorylates neomycin and kanamycin, or hpt, phosphorylating hygromycin, or genes conferring resistance to, for example, bleomycin, streptomycin, tetracyclin, chloramphenicol, ampicillin, gentamycin, geneticin (G418), spectinomycin or blasticidin), to herbicides (for example bar which provides resistance to Basta®; aroA or gox providing resistance against glyphosate, or the genes conferring resistance to, for example, imidazolinone, phosphinothricin or sulfonylurea), or genes that provide a metabolic trait (such as manA that allows plants to use mannose as sole carbon source or xylose isomerase for the utilisation of xylose, or antinutritive markers such as the resistance to 2-deoxyglucose). Expression of visual marker genes results in the formation of colour (for example β-glucuronidase, GUS or 3-galactosidase with its coloured substrates, for example X-Gal), luminescence (such as the luciferin/luceferase system) or fluorescence (Green Fluorescent Protein, GFP, and derivatives thereof). This list represents only a small number of possible markers. The skilled worker is familiar with such markers. Different markers are preferred, depending on the organism and the selection method.

It is known that upon stable or transient integration of nucleic acids into plant cells, only a minority of the cells takes up the foreign DNA and, if desired, integrates it into its genome, depending on the expression vector used and the transfection technique used. To identify and select these integrants, a gene coding for a selectable marker (such as the ones described above) is usually introduced into the host cells together with the gene of interest. These markers can for example be used in mutants in which these genes are not functional by, for example, deletion by conventional methods. Furthermore, nucleic acid molecules encoding a selectable marker can be introduced into a host cell on the same vector that comprises the sequence encoding the polypeptides of the invention or used in the methods of the invention, or else in a separate vector. Cells which have been stably transfected with the introduced nucleic acid can be identified for example by selection (for example, cells which have integrated the selectable marker survive whereas the other cells die).

Since the marker genes, particularly genes for resistance to antibiotics and herbicides, are no longer required or are undesired in the transgenic host cell once the nucleic acids have been introduced successfully, the process according to the invention for introducing the nucleic acids advantageously employs techniques which enable the removal or excision of these marker genes. One such a method is what is known as co-transformation. The co-transformation method employs two vectors simultaneously for the transformation, one vector bearing the nucleic acid according to the invention and a second bearing the marker gene(s). A large proportion of transformants receives or, in the case of plants, comprises (up to 40% or more of the transformants), both vectors. In case of transformation with *Agrobacteria*, the transformants usually receive only a part of the vector, i.e. the sequence flanked by the T-DNA, which usually represents the expression cassette. The marker genes can subsequently be removed from the transformed plant by performing crosses. In another method, marker genes integrated into a transposon are used for the transformation together with desired nucleic acid (known as the Ac/Ds technology). The transformants can be crossed with a transposase source or the transformants are transformed with a nucleic acid construct conferring expression of a transposase, transiently or stable. In some cases (approx. 10%), the transposon jumps out of the genome of the host cell once transformation has taken place successfully and is lost. In a further number of cases, the transposon jumps to a different location. In these cases the marker gene must be eliminated by performing crosses. In microbiology, techniques were developed which make possible, or facilitate, the detection of such events. A further advantageous method relies on what is known as recombination systems; whose advantage is that elimination by crossing can be dispensed with. The best-known system of this type is what is known as the Cre/lox system. Cre1 is a recombinase that removes the sequences located between the loxP sequences. If the marker gene is integrated between the loxP sequences, it is removed once transformation has taken place successfully, by expression of the recombinase. Further recombination systems are the HIN/HIX, FLP/FRT and REP/STB system (Tribble et al., J. Biol. Chem., 275, 2000: 22255-22267; Velmurugan et al., J. Cell Biol., 149, 2000: 553-566). A site-specific integration into the plant genome of the nucleic acid sequences according to the invention is possible. Naturally, these methods can also be applied to microorganisms such as yeast, fungi or bacteria.

Transgenic/Transgene/Recombinant

For the purposes of the invention, "transgenic", "transgene" or "recombinant" means with regard to, for example, a nucleic acid sequence, an expression cassette, gene construct or a vector comprising the nucleic acid sequence or an organism transformed with the nucleic acid sequences, expression cassettes or vectors according to the invention, all those constructions brought about by recombinant methods in which either (a) the nucleic acid sequences encoding proteins useful in the methods of the invention, or
(b) genetic control sequence(s) which is operably linked with the nucleic acid sequence according to the invention, for example a promoter, or
(c) a) and b)

are not located in their natural genetic environment or have been modified by recombinant methods, it being possible for the modification to take the form of, for example, a substitution, addition, deletion, inversion or insertion of one or more nucleotide residues. The natural genetic environment is understood as meaning the natural genomic or chromosomal locus in the original plant or the presence in a genomic library. In the case of a genomic library, the natural genetic environment of the nucleic acid sequence is preferably retained, at least in part. The environment flanks the nucleic acid sequence at least on one side and has a sequence length of at least 50 bp, preferably at least 500 bp, especially preferably at least 1000 bp, most preferably at least 5000 bp. A naturally occurring expression cassette—for example the naturally occurring combination of the natural promoter of the nucleic acid sequences with the corresponding nucleic acid sequence encoding a polypeptide useful in the methods of the present invention, as defined above—becomes a transgenic expression cassette when this expression cassette is modified by non-natural, synthetic ("artificial") methods such as, for example, mutagenic treatment. Suitable methods are described, for example, in U.S. Pat. No. 5,565,350 or WO 00/15815.

A transgenic plant for the purposes of the invention is thus understood as meaning, as above, that the nucleic acids used in the method of the invention are not at their natural locus in the genome of said plant, it being possible for the nucleic acids to be expressed homologously or heterologously. However, as mentioned, transgenic also means that, while the nucleic acids according to the invention or used in the inventive method are at their natural position in the genome of a plant, the sequence has been modified with regard to the natural sequence, and/or that the regulatory sequences of the natural sequences have been modified. Transgenic is preferably understood as meaning the expression of the nucleic acids according to the invention at an unnatural locus in the genome, i.e. homologous or, preferably, heterologous expression of the nucleic acids takes place. Preferred transgenic plants are mentioned herein.

Modulation

The term "modulation" means in relation to expression or gene expression, a process in which the expression level is changed by said gene expression in comparison to the control plant, the expression level may be increased or decreased. The original, unmodulated expression may be of any kind of expression of a structural RNA (rRNA, tRNA) or mRNA with subsequent translation. The term "modulating the activity" shall mean any change of the expression of the inventive nucleic acid sequences or encoded proteins, which leads to increased yield and/or increased growth of the plants.

Expression

The term "expression" or "gene expression" means the transcription of a specific gene or specific genes or specific genetic construct. The term "expression" or "gene expression" in particular means the transcription of a gene or genes or genetic construct into structural RNA (rRNA, tRNA) or mRNA with or without subsequent translation of the latter into a protein. The process includes transcription of DNA and processing of the resulting mRNA product.

Increased Expression/Overexpression

The term "increased expression" or "overexpression" as used herein means any form of expression that is additional to the original wild-type expression level.

Methods for increasing expression of genes or gene products are well documented in the art and include, for example, overexpression driven by appropriate promoters, the use of transcription enhancers or translation enhancers. Isolated nucleic acids which serve as promoter or enhancer elements may be introduced in an appropriate position (typically upstream) of a non-heterologous form of a polynucleotide so as to upregulate expression of a nucleic acid encoding the polypeptide of interest. For example, endogenous promoters may be altered in vivo by mutation, deletion, and/or substitution (see, Kmiec, U.S. Pat. No. 5,565,350; Zarling et al., WO9322443), or isolated promoters may be introduced into a plant cell in the proper orientation and distance from a gene of the present invention so as to control the expression of the gene.

If polypeptide expression is desired, it is generally desirable to include a polyadenylation region at the 3'-end of a polynucleotide coding region. The polyadenylation region can be derived from the natural gene, from a variety of other plant genes, or from T-DNA. The 3' end sequence to be added may be derived from, for example, the nopaline synthase or octopine synthase genes, or alternatively from another plant gene, or less preferably from any other eukaryotic gene.

An intron sequence may also be added to the 5' untranslated region (UTR) or the coding sequence of the partial coding sequence to increase the amount of the mature message that accumulates in the cytosol. Inclusion of a spliceable intron in the transcription unit in both plant and animal expression constructs has been shown to increase gene expression at both the mRNA and protein levels up to 1000-fold (Buchman and Berg (1988) Mol. Cell. biol. 8: 4395-4405; Callis et al. (1987) Genes Dev 1:1183-1200). Such intron enhancement of gene expression is typically greatest when placed near the 5' end of the transcription unit. Use of the maize introns Adh1-S intron 1, 2, and 6, the Bronze-1 intron are known in the art. For general information see: The Maize Handbook, Chapter 116, reeling and Walbot, Eds., Springer, N.Y. (1994).

Decreased Expression

Reference herein to "decreased expression" or "reduction or substantial elimination" of expression is taken to mean a decrease in endogenous gene expression and/or polypeptide levels and/or polypeptide activity relative to control plants. The reduction or substantial elimination is in increasing order of preference at least 10%, 20%, 30%, 40% or 50%, 60%, 70%, 80%, 85%, 90%, or 95%, 96%, 97%, 98%, 99% or more reduced compared to that of control plants.

For the reduction or substantial elimination of expression an endogenous gene in a plant, a sufficient length of substantially contiguous nucleotides of a nucleic acid sequence is required. In order to perform gene silencing, this may be as little as 20, 19, 18, 17, 16, 15, 14, 13, 12, 11, 10 or fewer nucleotides, alternatively this may be as much as the entire gene (including the 5' and/or 3' UTR, either in part or in whole). The stretch of substantially contiguous nucleotides may be derived from the nucleic acid encoding the protein of interest (target gene), or from any nucleic acid capable of encoding an orthologue, paralogue or homologue of the protein of interest. Preferably, the stretch of substantially contiguous nucleotides is capable of forming hydrogen bonds with the target gene (either sense or antisense strand), more preferably, the stretch of substantially contiguous nucleotides has, in increasing order of preference, 50%, 60%, 70%, 80%, 85%, 90%, 95%, 96%, 97%, 98%, 99%, 100% sequence identity to the target gene (either sense or antisense strand). A nucleic acid sequence encoding a (functional) polypeptide is not a requirement for the various methods discussed herein for the reduction or substantial elimination of expression of an endogenous gene.

This reduction or substantial elimination of expression may be achieved using routine tools and techniques. A preferred method for the reduction or substantial elimination of endogenous gene expression is by introducing and expressing in a plant a genetic construct into which the nucleic acid (in this case a stretch of substantially contiguous nucleotides derived from the gene of interest, or from any nucleic acid capable of encoding an orthologue, paralogue or homologue of any one of the protein of interest) is cloned as an inverted repeat (in part or completely), separated by a spacer (non-coding DNA).

In such a preferred method, expression of the endogenous gene is reduced or substantially eliminated through RNA-mediated silencing using an inverted repeat of a nucleic acid or a part thereof (in this case a stretch of substantially contiguous nucleotides derived from the gene of interest, or from any nucleic acid capable of encoding an orthologue, paralogue or homologue of the protein of interest), preferably capable of forming a hairpin structure. The inverted repeat is cloned in an expression vector comprising control sequences. A non-coding DNA nucleic acid sequence (a spacer, for example a matrix attachment region fragment (MAR), an intron, a polylinker, etc.) is located between the two inverted nucleic acids forming the inverted repeat. After transcription of the inverted repeat, a chimeric RNA with a self-complementary structure is formed (partial or complete). This double-stranded RNA structure is referred to as the hairpin RNA (hpRNA). The hpRNA is processed by the plant into siRNAs that are incorporated into an RNA-induced silencing complex (RISC). The RISC further cleaves the mRNA transcripts, thereby substantially reducing the number of mRNA transcripts to be translated into polypeptides. For further general details see for example, Grierson et al. (1998) WO 98/53083; Waterhouse et al. (1999) WO 99/53050).

Performance of the methods of the invention does not rely on introducing and expressing in a plant a genetic construct into which the nucleic acid is cloned as an inverted repeat, but any one or more of several well-known "gene silencing" methods may be used to achieve the same effects.

One such method for the reduction of endogenous gene expression is RNA-mediated silencing of gene expression (downregulation). Silencing in this case is triggered in a plant by a double stranded RNA sequence (dsRNA) that is substantially similar to the target endogenous gene. This dsRNA is further processed by the plant into about 20 to about 26 nucleotides called short interfering RNAs (siRNAs). The siRNAs are incorporated into an RNA-induced silencing complex (RISC) that cleaves the mRNA transcript of the endogenous target gene, thereby substantially reducing the number of mRNA transcripts to be translated into a polypeptide. Preferably, the double stranded RNA sequence corresponds to a target gene.

Another example of an RNA silencing method involves the introduction of nucleic acid sequences or parts thereof (in this case a stretch of substantially contiguous nucleotides derived from the gene of interest, or from any nucleic acid capable of encoding an orthologue, paralogue or homologue of the protein of interest) in a sense orientation into a plant. "Sense orientation" refers to a DNA sequence that is homologous to an mRNA transcript thereof. Introduced into a plant would therefore be at least one copy of the nucleic acid sequence. The additional nucleic acid sequence will reduce expression of the endogenous gene, giving rise to a phenomenon known as co-suppression. The reduction of gene expression will be more pronounced if several additional copies of a nucleic acid sequence are introduced into the plant, as there is a positive correlation between high transcript levels and the triggering of co-suppression.

Another example of an RNA silencing method involves the use of antisense nucleic acid sequences. An "antisense" nucleic acid sequence comprises a nucleotide sequence that is complementary to a "sense" nucleic acid sequence encoding a protein, i.e. complementary to the coding strand of a double-stranded cDNA molecule or complementary to an mRNA transcript sequence. The antisense nucleic acid sequence is preferably complementary to the endogenous gene to be silenced. The complementarity may be located in the "coding region" and/or in the "non-coding region" of a gene. The term "coding region" refers to a region of the nucleotide sequence comprising codons that are translated into amino acid residues. The term "non-coding region" refers to 5' and 3' sequences that flank the coding region that are transcribed but not translated into amino acids (also referred to as 5' and 3' untranslated regions).

Antisense nucleic acid sequences can be designed according to the rules of Watson and Crick base pairing. The antisense nucleic acid sequence may be complementary to the entire nucleic acid sequence (in this case a stretch of substantially contiguous nucleotides derived from the gene of interest, or from any nucleic acid capable of encoding an orthologue, paralogue or homologue of the protein of interest), but may also be an oligonucleotide that is antisense to only a part of the nucleic acid sequence (including the mRNA 5' and 3' UTR). For example, the antisense oligonucleotide sequence may be complementary to the region surrounding the translation start site of an mRNA transcript encoding a polypeptide. The length of a suitable antisense oligonucleotide sequence is known in the art and may start from about 50, 45, 40, 35, 30, 25, 20, 15 or 10 nucleotides in length or less. An antisense nucleic acid sequence according to the invention may be constructed using chemical synthesis and enzymatic ligation reactions using methods known in the art. For example, an antisense nucleic acid sequence (e.g., an antisense oligonucleotide sequence) may be chemically synthesized using naturally occurring nucleotides or variously modified nucleotides designed to increase the biological stability of the molecules or to increase the physical stability of the duplex formed between the antisense and sense nucleic acid sequences, e.g., phosphorothioate derivatives and acridine substituted nucleotides may be used. Examples of modified nucleotides that may be used to generate the antisense nucleic acid sequences are well known in the art. Known nucleotide modifications include methylation, cyclization and 'caps' and substitution of one or more of the naturally occurring nucleotides with an analogue such as inosine. Other modifications of nucleotides are well known in the art.

The antisense nucleic acid sequence can be produced biologically using an expression vector into which a nucleic acid sequence has been subcloned in an antisense orientation (i.e., RNA transcribed from the inserted nucleic acid will be of an antisense orientation to a target nucleic acid of interest). Preferably, production of antisense nucleic acid sequences in plants occurs by means of a stably integrated nucleic acid construct comprising a promoter, an operably linked antisense oligonucleotide, and a terminator.

The nucleic acid molecules used for silencing in the methods of the invention (whether introduced into a plant or generated in situ) hybridize with or bind to mRNA transcripts and/or genomic DNA encoding a polypeptide to thereby inhibit expression of the protein, e.g., by inhibiting transcription and/or translation. The hybridization can be by conventional nucleotide complementarity to form a stable duplex, or, for example, in the case of an antisense nucleic acid sequence which binds to DNA duplexes, through specific interactions in the major groove of the double helix. Antisense nucleic acid sequences may be introduced into a plant by transformation or direct injection at a specific tissue site. Alternatively, antisense nucleic acid sequences can be modified to target selected cells and then administered systemically. For example, for systemic administration, antisense nucleic acid sequences can be modified such that they specifically bind to receptors or antigens expressed on a selected cell surface, e.g., by linking the antisense nucleic acid sequence to peptides or antibodies which bind to cell surface receptors or antigens. The antisense nucleic acid sequences can also be delivered to cells using the vectors described herein.

According to a further aspect, the antisense nucleic acid sequence is an a-anomeric nucleic acid sequence. An a-anomeric nucleic acid sequence forms specific double-stranded hybrids with complementary RNA in which, contrary to the usual b-units, the strands run parallel to each other (Gaultier et al. (1987) Nucl Ac Res 15: 6625-6641). The antisense nucleic acid sequence may also comprise a 2'-o-methylribonucleotide (Inoue et al. (1987) Nucl Ac Res 15, 6131-6148) or a chimeric RNA-DNA analogue (Inoue et al. (1987) FEBS Lett. 215, 327-330).

The reduction or substantial elimination of endogenous gene expression may also be performed using ribozymes. Ribozymes are catalytic RNA molecules with ribonuclease activity that are capable of cleaving a single-stranded nucleic acid sequence, such as an mRNA, to which they have a complementary region. Thus, ribozymes (e.g., hammerhead ribozymes (described in Haselhoff and Gerlach (1988) Nature 334, 585-591) can be used to catalytically cleave mRNA transcripts encoding a polypeptide, thereby substantially reducing the number of mRNA transcripts to be translated into a polypeptide. A ribozyme having specificity for a nucleic acid sequence can be designed (see for example: Cech et al. U.S. Pat. No. 4,987,071; and Cech et al. U.S. Pat. No. 5,116,742). Alternatively, mRNA transcripts corresponding to a nucleic acid sequence can be used to select a catalytic RNA having a specific ribonuclease activity from a pool of RNA molecules (Bartel and Szostak (1993) Science 261, 1411-1418). The use of ribozymes for gene silencing in plants is known in the art (e.g., Atkins et al. (1994) WO 94/00012; Lenne et al. (1995) WO 95/03404; Lutziger et al. (2000) WO 00/00619; Prinsen et al. (1997) WO 97/13865 and Scott et al. (1997) WO 97/38116).

Gene silencing may also be achieved by insertion mutagenesis (for example, T-DNA insertion or transposon insertion) or by strategies as described by, among others, Angell and Baulcombe ((1999) Plant J 20(3): 357-62), (Amplicon VIGS WO 98/36083), or Baulcombe (WO 99/15682).

Gene silencing may also occur if there is a mutation on an endogenous gene and/or a mutation on an isolated gene/nucleic acid subsequently introduced into a plant. The reduction or substantial elimination may be caused by a non-functional polypeptide. For example, the polypeptide may bind to various interacting proteins; one or more mutation(s) and/or truncation(s) may therefore provide for a polypeptide that is still able to bind interacting proteins (such as receptor proteins) but that cannot exhibit its normal function (such as signalling ligand).

A further approach to gene silencing is by targeting nucleic acid sequences complementary to the regulatory region of the gene (e.g., the promoter and/or enhancers) to form triple helical structures that prevent transcription of the gene in target cells. See Helene, C., Anticancer Drug Res. 6, 569-84, 1991; Helene et al., Ann. N.Y. Acad. Sci. 660, 27-36 1992; and Maher, L. J. Bioassays 14, 807-15, 1992.

Other methods, such as the use of antibodies directed to an endogenous polypeptide for inhibiting its function in planta, or interference in the signalling pathway in which a polypeptide is involved, will be well known to the skilled man. In particular, it can be envisaged that manmade molecules may be useful for inhibiting the biological function of a target polypeptide, or for interfering with the signalling pathway in which the target polypeptide is involved.

Alternatively, a screening program may be set up to identify in a plant population natural variants of a gene, which variants encode polypeptides with reduced activity. Such natural variants may also be used for example, to perform homologous recombination.

Artificial and/or natural microRNAs (miRNAs) may be used to knock out gene expression and/or mRNA translation. Endogenous miRNAs are single stranded small RNAs of typically 19-24 nucleotides long. They function primarily to regulate gene expression and/or mRNA translation. Most plant microRNAs (miRNAs) have perfect or near-perfect complementarity with their target sequences. However, there are natural targets with up to five mismatches. They are processed from longer non-coding RNAs with characteristic fold-back structures by double-strand specific RNases of the Dicer family. Upon processing, they are incorporated in the RNA-induced silencing complex (RISC) by binding to its main component, an Argonaute protein. mRNAs serve as the specificity components of RISC, since they base-pair to target nucleic acids, mostly mRNAs, in the cytoplasm. Subsequent regulatory events include target mRNA cleavage and destruction and/or translational inhibition. Effects of miRNA overexpression are thus often reflected in decreased mRNA levels of target genes.

Artificial microRNAs (amiRNAs), which are typically 21 nucleotides in length, can be genetically engineered specifically to negatively regulate gene expression of single or multiple genes of interest. Determinants of plant microRNA target selection are well known in the art. Empirical parameters for target recognition have been defined and can be used to aid in the design of specific amiRNAs, (Schwab et al., Dev. Cell 8, 517-527, 2005). Convenient tools for design and generation of amiRNAs and their precursors are also available to the public (Schwab et al., Plant Cell 18, 1121-1133, 2006).

For optimal performance, the gene silencing techniques used for reducing expression in a plant of an endogenous gene requires the use of nucleic acid sequences from monocotyledonous plants for transformation of monocotyledonous plants, and from dicotyledonous plants for transformation of dicotyledonous plants. Preferably, a nucleic acid sequence from any given plant species is introduced into that same species. For example, a nucleic acid sequence from rice is transformed into a rice plant. However, it is not an absolute requirement that the nucleic acid sequence to be introduced originates from the same plant species as the plant in which it will be introduced. It is sufficient that there is substantial homology between the endogenous target gene and the nucleic acid to be introduced.

Described above are examples of various methods for the reduction or substantial elimination of expression in a plant of an endogenous gene. A person skilled in the art would readily be able to adapt the aforementioned methods for silencing so as to achieve reduction of expression of an endogenous gene in a whole plant or in parts thereof through the use of an appropriate promoter, for example.

Transformation

The term "introduction" or "transformation" as referred to herein encompasses the transfer of an exogenous polynucleotide into a host cell, irrespective of the method used for transfer. Plant tissue capable of subsequent clonal propagation, whether by organogenesis or embryogenesis, may be transformed with a genetic construct of the present invention and a whole plant regenerated there from. The particular tissue chosen will vary depending on the clonal propagation systems available for, and best suited to, the particular species being transformed. Exemplary tissue targets include leaf disks, pollen, embryos, cotyledons, hypocotyls, megagametophytes, callus tissue, existing meristematic tissue (e.g., apical meristem, axillary buds, and root meristems), and induced meristem tissue (e.g., cotyledon meristem and hypocotyl meristem). The polynucleotide may be transiently or stably introduced into a host cell and may be maintained non-integrated, for example, as a plasmid. Alternatively, it may be integrated into the host genome. The resulting transformed plant cell may then be used to regenerate a transformed plant in a manner known to persons skilled in the art.

The transfer of foreign genes into the genome of a plant is called transformation. Transformation of plant species is now a fairly routine technique. Advantageously, any of several transformation methods may be used to introduce the gene of interest into a suitable ancestor cell. The methods described for the transformation and regeneration of plants from plant tissues or plant cells may be utilized for transient or for stable transformation. Transformation methods include the use of liposomes, electroporation, chemicals that increase free DNA uptake, injection of the DNA directly into the plant, particle gun bombardment, transformation using viruses or pollen and microprojection. Methods may be selected from the calcium/polyethylene glycol method for protoplasts (Krens, F. A. et al., (1982) Nature 296, 72-74; Negrutiu I et al. (1987) Plant Mol Biol 8: 363-373); electroporation of protoplasts (Shillito R. D. et al. (1985) Bio/Technol 3, 1099-1102); microinjection into plant material (Crossway A et al., (1986) Mol. Gen. Genet. 202: 179-185); DNA or RNA-coated particle bombardment (Klein T M et al., (1987) Nature 327: 70) infection with (non-integrative) viruses and the like. Transgenic plants, including transgenic crop plants, are preferably produced via *Agrobacterium*-mediated transformation. An advantageous transformation method is the transformation in planta. To this end, it is possible, for example, to allow the *agrobacteria* to act on plant seeds or to inoculate the plant meristem with *agrobacteria*. It has proved particularly expedient in accordance with the invention to allow a suspension of transformed *agrobacteria* to act on the intact plant or at least on the flower primordia. The plant is subsequently grown on until the seeds of the treated plant are obtained (Clough and Bent, Plant J. (1998) 16, 735-743). Methods for *Agrobacterium*-mediated transformation of rice include well known methods for rice transformation, such as those described in any of the following: European patent application EP 1198985 A1, Aldemita and Hodges (Planta 199: 612-617, 1996); Chan et al. (Plant Mol Biol 22 (3): 491-506, 1993), Hiei et al. (Plant J 6 (2): 271-282, 1994), which disclosures are incorporated by reference herein as if fully set forth. In the case of corn transformation, the preferred method is as described in either Ishida et al. (Nat. Biotechnol 14(6): 745-50, 1996) or Frame et al. (Plant Physiol 129(1): 13-22, 2002), which disclosures are incorporated by reference herein as if fully set forth. Said methods are further described by way of example in B. Jenes et al., Techniques for Gene Transfer, in: Transgenic Plants, Vol. 1, Engineering and Utilization, eds. S. D. Kung and R. Wu, Academic Press (1993) 128-143 and in Potrykus Annu. Rev. Plant Physiol. Plant Molec. Biol. 42 (1991) 205-225). The nucleic acids or the construct to be expressed is preferably cloned into a vector, which is suitable for transforming *Agrobacterium tumefaciens*, for example pBin19 (Bevan et al., Nucl. Acids Res. 12 (1984) 8711). *Agrobacteria* transformed by such a vector can then be used in known manner for the transformation of plants, such as plants used as a model, like *Arabidopsis* (*Arabidopsis thaliana* is within the scope of the present invention not considered as a crop plant), or crop plants such as, by way of example, tobacco plants, for example by immersing bruised leaves or chopped leaves in an agrobacterial solution and then culturing them in suitable media. The transformation of plants by means of *Agrobacterium tumefaciens* is described, for example, by Höfgen and Willmitzer in Nucl. Acid Res. (1988) 16, 9877 or is known inter alia from F. F. White, Vectors for Gene Transfer in Higher Plants; in Transgenic Plants, Vol. 1, Engineering and Utilization, eds. S. D. Kung and R. Wu, Academic Press, 1993, pp. 15-38.

In addition to the transformation of somatic cells, which then have to be regenerated into intact plants, it is also possible to transform the cells of plant meristems and in particular those cells which develop into gametes. In this case, the transformed gametes follow the natural plant development, giving rise to transgenic plants. Thus, for example, seeds of *Arabidopsis* are treated with *agrobacteria* and seeds are obtained from the developing plants of which a certain proportion is transformed and thus transgenic [Feldman, K A and Marks M D (1987). Mol Gen Genet. 208:274-289; Feldmann K (1992). In: C Koncz, N-H Chua and J Shell, eds, Methods in *Arabidopsis* Research. Word Scientific, Singapore, pp. 274-289]. Alternative methods are based on the repeated removal f the inflorescences and incubation of the excision site in the center of the rosette with transformed *agrobacteria*, whereby transformed seeds can likewise be obtained at a later point in time (Chang (1994). Plant J. 5: 551-558; Katavic (1994). Mol Gen Genet, 245: 363-370). However, an especially effective method is the vacuum infiltration method with its modifications such as the "floral dip" method. In the case of vacuum infiltration of *Arabidopsis*, intact plants under reduced pressure are treated with an agrobacterial suspension [Bechthold, N (1993). C R Acad Sci Paris Life Sci, 316: 1194-1199], while in the case of the "floral dip" method the developing floral tissue is incubated briefly with a surfactant-treated agrobacterial suspension [Clough, S J and Bent A F (1998) The Plant J. 16, 735-743]. A certain proportion of transgenic seeds are harvested in both cases, and these seeds can be distinguished from non-transgenic seeds by growing under the above-described selective conditions. In addition the stable transformation of plastids is of advantages because plastids are inherited maternally is most crops reducing or eliminating the risk of transgene flow through pollen. The transformation of the chloroplast genome is generally achieved by a process which has been schematically displayed in Klaus et al., 2004 [Nature Biotechnology 22 (2), 225-229]. Briefly the sequences to be transformed are cloned together with a selectable marker gene between flanking sequences homologous to the chloroplast genome. These homologous flanking sequences direct site specific integration into the plastome. Plastidal transformation has been described for many different plant species and an overview is given in Bock (2001) Transgenic plastids in basic research and plant biotechnology. J Mol. Biol. 2001 Sep. 21; 312 (3):425-38 or Maliga, P (2003) Progress towards commercialization of plastid transformation technology. Trends Biotechnol. 21, 20-28. Further biotechnological progress has recently been reported in form of marker free plastid transformants, which can be produced by a transient co-integrated maker gene (Klaus et al., 2004, Nature Biotechnology 22(2), 225-229).

The genetically modified plant cells can be regenerated via all methods with which the skilled worker is familiar. Suitable methods can be found in the abovementioned publications by S. D. Kung and R. Wu, Potrykus or Höfgen and Willmitzer.

Generally after transformation, plant cells or cell groupings are selected for the presence of one or more markers which are encoded by plant-expressible genes co-transferred with the gene of interest, following which the transformed material is regenerated into a whole plant. To select transformed plants, the plant material obtained in the transformation is, as a rule, subjected to selective conditions so that transformed plants can be distinguished from untransformed plants. For example, the seeds obtained in the above-described manner can be planted and, after an initial growing period, subjected to a suitable selection by spraying. A further possibility consists in growing the seeds, if appropriate after sterilization, on agar plates using a suitable selection agent so that only the transformed seeds can grow into plants. Alternatively, the transformed plants are screened for the presence of a selectable marker such as the ones described above.

Following DNA transfer and regeneration, putatively transformed plants may also be evaluated, for instance using Southern analysis, for the presence of the gene of interest, copy number and/or genomic organisation. Alternatively or additionally, expression levels of the newly introduced DNA may be monitored using Northern and/or Western analysis, both techniques being well known to persons having ordinary skill in the art.

The generated transformed plants may be propagated by a variety of means, such as by clonal propagation or classical breeding techniques. For example, a first generation (or T1) transformed plant may be selfed and homozygous second-generation (or T2) transformants selected, and the T2 plants may then further be propagated through classical breeding techniques. The generated transformed organisms may take a variety of forms. For example, they may be chimeras of transformed cells and non-transformed cells; clonal transformants (e.g., all cells transformed to contain the expression cassette); grafts of transformed and untransformed tissues (e.g., in plants, a transformed rootstock grafted to an untransformed scion).

T-DNA Activation Tagging

T-DNA activation tagging (Hayashi et al. Science (1992) 1350-1353), involves insertion of T-DNA, usually containing a promoter (may also be a translation enhancer or an intron), in the genomic region of the gene of interest or 10 kb up- or downstream of the coding region of a gene in a configuration such that the promoter directs expression of the targeted gene. Typically, regulation of expression of the targeted gene by its natural promoter is disrupted and the gene falls under the control of the newly introduced promoter. The promoter is typically embedded in a T-DNA. This T-DNA is randomly inserted into the plant genome, for example, through *Agrobacterium* infection and leads to modified expression of genes near the inserted T-DNA. The resulting transgenic plants show dominant phenotypes due to modified expression of genes close to the introduced promoter.

Tilling

The term "TILLING" is an abbreviation of "Targeted Induced Local Lesions In Genomes" and refers to a mutagenesis technology useful to generate and/or identify nucleic acids encoding proteins with modified expression and/or activity. TILLING also allows selection of plants carrying such mutant variants. These mutant variants may exhibit modified expression, either in strength or in location or in timing (if the mutations affect the promoter for example). These mutant variants may exhibit higher activity than that exhibited by the gene in its natural form. TILLING combines high-density mutagenesis with high-throughput screening methods. The steps typically followed in TILLING are: (a) EMS mutagenesis (Redei G P and Koncz C (1992) In Methods in *Arabidopsis* Research, Koncz C, Chua N H, Schell J, eds. Singapore, World Scientific Publishing Co, pp. 16-82; Feldmann et al., (1994) In Meyerowitz E M, Somerville C R, eds, *Arabidopsis*. Cold Spring Harbor Laboratory Press, Cold Spring Harbor, N.Y., pp 137-172; Lightner J and Caspar T (1998) In J Martinez-Zapater, J Salinas, eds, Methods on Molecular Biology, Vol. 82. Humana Press, Totowa, N. J., pp 91-104); (b) DNA preparation and pooling of individuals; (c) PCR amplification of a region of interest; (d) denaturation and annealing to allow formation of heteroduplexes; (e) DHPLC, where the presence of a heteroduplex in a pool is detected as an extra peak in the chromatogram; (f) identification of the mutant individual; and (g) sequencing of the mutant PCR product. Methods for TILLING are well known in the art (McCallum et al., (2000) Nat Biotechnol 18: 455-457; reviewed by Stemple (2004) Nat Rev Genet. 5(2): 145-50).

Homologous Recombination

Homologous recombination allows introduction in a genome of a selected nucleic acid at a defined selected position. Homologous recombination is a standard technology used routinely in biological sciences for lower organisms such as yeast or the moss *Physcomitrella*. Methods for performing homologous recombination in plants have been described not only for model plants (Offring a et al. (1990) EMBO J. 9(10): 3077-84) but also for crop plants, for example rice (Terada et al. (2002) Nat Biotech 20(10): 1030-4; Iida and Terada (2004) Curr Opin Biotech 15(2): 132-8), and approaches exist that are generally applicable regardless of the target organism (Miller et al, Nature Biotechnol. 25, 778-785, 2007).

Yield Related Traits

Yield related traits comprise one or more of yield, biomass, seed yield, early vigour, greenness index, increased growth rate, improved agronomic traits (such as improved Water Use Efficiency (WUE), Nitrogen Use Efficiency (NUE), etc.).

Yield

The term "yield" in general means a measurable produce of economic value, typically related to a specified crop, to an area, and to a period of time. Individual plant parts directly contribute to yield based on their number, size and/or weight, or the actual yield is the yield per square meter for a crop and year, which is determined by dividing total production (includes both harvested and appraised production) by planted square meters. The term "yield" of a plant may relate to vegetative biomass (root and/or shoot biomass), to reproductive organs, and/or to propagules (such as seeds) of that plant.

Taking corn as an example, a yield increase may be manifested as one or more of the following: increase in the number of plants established per square meter, an increase in the number of ears per plant, an increase in the number of rows, number of kernels per row, kernel weight, thousand kernel weight, ear length/diameter, increase in the seed filling rate (which is the number of filled seeds divided by the total number of seeds and multiplied by 100), among others. Taking rice as an example, a yield increase may manifest itself as an increase in one or more of the following: number of plants per square meter, number of panicles per plant, panicle length, number of spikelets per panicle, number of flowers (florets) per panicle, increase in the seed filling rate (which is the number of filled seeds divided by the total number of seeds and multiplied by 100), increase in thousand kernel weight, among others. In rice, submergence tolerance may also result in increased yield.

Early Vigour

"Early vigour" refers to active healthy well-balanced growth especially during early stages of plant growth, and may result from increased plant fitness due to, for example, the plants being better adapted to their environment (i.e. optimizing the use of energy resources and partitioning between shoot and root). Plants having early vigour also show increased seedling survival and a better establishment of the crop, which often results in highly uniform fields (with the crop growing in uniform manner, i.e. with the majority of plants reaching the various stages of development at substantially the same time), and often better and higher yield. Therefore, early vigour may be determined by measuring various factors, such as thousand kernel weight, percentage germination, percentage emergence, seedling growth, seedling height, root length, root and shoot biomass and many more.

Increased Growth Rate

The increased growth rate may be specific to one or more parts of a plant (including seeds), or may be throughout substantially the whole plant. Plants having an increased growth rate may have a shorter life cycle. The life cycle of a plant may be taken to mean the time needed to grow from a dry mature seed up to the stage where the plant has produced dry mature seeds, similar to the starting material. This life cycle may be influenced by factors such as speed of germination, early vigour, growth rate, greenness index, flowering time and speed of seed maturation. The increase in growth rate may take place at one or more stages in the life cycle of a plant or during substantially the whole plant life cycle. Increased growth rate during the early stages in the life cycle of a plant may reflect enhanced vigour. The increase in growth rate may alter the harvest cycle of a plant allowing plants to be sown later and/or harvested sooner than would otherwise be possible (a similar effect may be obtained with earlier flowering time). If the growth rate is sufficiently increased, it may allow for the further sowing of seeds of the same plant species (for example sowing and harvesting of rice plants followed by sowing and harvesting of further rice plants all within one conventional growing period). Similarly, if the growth rate is sufficiently increased, it may allow for the further sowing of seeds of different plants species (for example the sowing and harvesting of corn plants followed by, for example, the sowing and optional harvesting of soybean, potato or any other suitable plant). Harvesting additional times from the same rootstock in the case of some crop plants may also be possible. Altering the harvest cycle of a plant may lead to an increase in annual biomass production per square meter (due to an increase in the number of times (say in a year) that any particular plant may be grown and harvested). An increase in growth rate may also allow for the cultivation of transgenic plants in a wider geographical area than their wild-type counterparts, since the territorial limitations for growing a crop are often determined by adverse environmental conditions either at the time of planting (early season) or at the time of harvesting (late season). Such adverse conditions may be avoided if the harvest cycle is shortened. The growth rate may be determined by deriving various parameters from growth curves, such parameters may be: T-Mid (the time taken for plants to reach 50% of their maximal size) and T-90 (time taken for plants to reach 90% of their maximal size), amongst others.

Stress Resistance

An increase in yield and/or growth rate occurs whether the plant is under non-stress conditions or whether the plant is exposed to various stresses compared to control plants. Plants typically respond to exposure to stress by growing more slowly. In conditions of severe stress, the plant may even stop growing altogether. Mild stress on the other hand is defined herein as being any stress to which a plant is exposed which does not result in the plant ceasing to grow altogether without the capacity to resume growth. Mild stress in the sense of the invention leads to a reduction in the growth of the stressed plants of less than 40%, 35%, 30% or 25%, more preferably less than 20% or 15% in comparison to the control plant under non-stress conditions. Due to advances in agricultural practices (irrigation, fertilization, pesticide treatments) severe stresses are not often encountered in cultivated crop plants. As a consequence, the compromised growth induced by mild stress is often an undesirable feature for agriculture. Mild stresses are the everyday biotic and/or abiotic (environmental) stresses to which a plant is exposed. Abiotic stresses may be due to drought or excess water, anaerobic stress, salt stress, chemical toxicity, oxidative stress and hot, cold or freezing temperatures. The abiotic stress may be an osmotic stress caused by a water stress (particularly due to drought), salt stress, oxidative stress or an ionic stress. Biotic stresses are typically those stresses caused by pathogens, such as bacteria, viruses, fungi, nematodes and insects.

In particular, the methods of the present invention may be performed under non-stress conditions or under conditions of mild drought to give plants having increased yield relative to control plants. As reported in Wang et al. (Planta (2003) 218: 1-14), abiotic stress leads to a series of morphological, physiological, biochemical and molecular changes that adversely affect plant growth and productivity. Drought, salinity, extreme temperatures and oxidative stress are known to be interconnected and may induce growth and cellular damage through similar mechanisms. Rabbani et al. (Plant Physiol (2003) 133: 1755-1767) describes a particularly high degree of "cross talk" between drought stress and high-salinity stress. For example, drought and/or salinisation are manifested primarily as osmotic stress, resulting in the disruption of homeostasis and ion distribution in the cell. Oxidative stress, which frequently accompanies high or low temperature, salinity or drought stress, may cause denaturing of functional and structural proteins. As a consequence, these diverse environmental stresses often activate similar cell signalling pathways and cellular responses, such as the production of stress proteins, up-regulation of anti-oxidants, accumulation of compatible solutes and growth arrest. The term "non-stress" conditions as used herein are those environmental conditions that allow optimal growth of plants. Persons skilled in the art are aware of normal soil conditions and climatic conditions for a given location. Plants with optimal growth conditions, (grown under non-stress conditions) typically yield in increasing order of preference at least 97%, 95%, 92%, 90%, 87%, 85%, 83%, 80%, 77% or 75% of the average production of such plant in a given environment. Average production may be calculated on harvest and/or season basis. Persons skilled in the art are aware of average yield productions of a crop.

Nutrient deficiency may result from a lack of nutrients such as nitrogen, phosphates and other phosphorous-containing compounds, potassium, calcium, magnesium, manganese, iron and boron, amongst others.

The term salt stress is not restricted to common salt (NaCl), but may be any one or more of: NaCl, KCl, LiCl, $MgCl_2$, $CaCl_2$, amongst others.

Increase/Improve/Enhance

The terms "increase", "improve" or "enhance" are interchangeable and shall mean in the sense of the application at least a 3%, 4%, 5%, 6%, 7%, 8%, 9% or 10%, preferably at least 15% or 20%, more preferably 25%, 30%, 35% or 40% more yield and/or growth in comparison to control plants as defined herein.

Seed Yield

Increased seed yield may manifest itself as one or more of the following: a) an increase in seed biomass (total seed weight) which may be on an individual seed basis and/or per plant and/or per square meter; b) increased number of flowers per plant; c) increased number of (filled) seeds; d) increased seed filling rate (which is expressed as the ratio between the number of filled seeds divided by the total number of seeds); e) increased harvest index, which is expressed as a ratio of the yield of harvestable parts, such as seeds, divided by the total biomass; and f) increased thousand kernel weight (TKW), which is extrapolated from the number of filled seeds counted and their total weight. An increased TKW may result from an increased seed size and/or seed weight, and may also result from an increase in embryo and/or endosperm size.

An increase in seed yield may also be manifested as an increase in seed size and/or seed volume. Furthermore, an increase in seed yield may also manifest itself as an increase in seed area and/or seed length and/or seed width and/or seed perimeter. Increased yield may also result in modified architecture, or may occur because of modified architecture.

Greenness Index

The "greenness index" as used herein is calculated from digital images of plants. For each pixel belonging to the plant object on the image, the ratio of the green value versus the red value (in the RGB model for encoding color) is calculated. The greenness index is expressed as the percentage of pixels for which the green-to-red ratio exceeds a given threshold. Under normal growth conditions, under salt stress growth conditions, and under reduced nutrient availability growth conditions, the greenness index of plants is measured in the last imaging before flowering. In contrast, under drought stress growth conditions, the greenness index of plants is measured in the first imaging after drought.

Marker Assisted Breeding

Such breeding programmes sometimes require introduction of allelic variation by mutagenic treatment of the plants, using for example EMS mutagenesis; alternatively, the programme may start with a collection of allelic variants of so called "natural" origin caused unintentionally. Identification of allelic variants then takes place, for example, by PCR. This is followed by a step for selection of superior allelic variants of the sequence in question and which give increased yield. Selection is typically carried out by monitoring growth performance of plants containing different allelic variants of the sequence in question. Growth performance may be monitored in a greenhouse or in the field. Further optional steps include crossing plants in which the superior allelic variant was identified with another plant. This could be used, for example, to make a combination of interesting phenotypic features.

Use as Probes in (Gene Mapping)

Use of nucleic acids encoding the protein of interest for genetically and physically mapping the genes requires only a nucleic acid sequence of at least 15 nucleotides in length. These nucleic acids may be used as restriction fragment length polymorphism (RFLP) markers. Southern blots (Sambrook J, Fritsch E F and Maniatis T (1989) Molecular Cloning, A Laboratory Manual) of restriction-digested plant genomic DNA may be probed with the ISYT-LIKE-encoding nucleic acids. The resulting banding patterns may then be subjected to genetic analyses using computer programs such as MapMaker (Lander et al. (1987) Genomics 1: 174-181) in order to construct a genetic map. In addition, the nucleic acids may be used to probe Southern blots containing restriction endonuclease-treated genomic DNAs of a set of individuals representing parent and progeny of a defined genetic cross. Segregation of the DNA polymorphisms is noted and used to calculate the position of the iSYT-like polypeptide-encoding nucleic acid in the genetic map previously obtained using this population (Botstein et al. (1980) Am. J. Hum. Genet. 32:314-331).

The production and use of plant gene-derived probes for use in genetic mapping is described in Bernatzky and Tanksley (1986) Plant Mol. Biol. Reporter 4: 37-41. Numerous publications describe genetic mapping of specific cDNA clones using the methodology outlined above or variations thereof. For example, F2 intercross populations, backcross populations, randomly mated populations, near isogenic lines, and other sets of individuals may be used for mapping. Such methodologies are well known to those skilled in the art.

The nucleic acid probes may also be used for physical mapping (i.e., placement of sequences on physical maps; see Hoheisel et al. In: Non-mammalian Genomic Analysis: A Practical Guide, Academic press 1996, pp. 319-346, and references cited therein).

In another embodiment, the nucleic acid probes may be used in direct fluorescence in situ hybridisation (FISH) mapping (Trask (1991) Trends Genet. 7:149-154). Although current methods of FISH mapping favour use of large clones (several kb to several hundred kb; see Laan et al. (1995) Genome Res. 5:13-20), improvements in sensitivity may allow performance of FISH mapping using shorter probes.

A variety of nucleic acid amplification-based methods for genetic and physical mapping may be carried out using the nucleic acids. Examples include allele-specific amplification (Kazazian (1989) J. Lab. Clin. Med. 11:95-96), polymorphism of PCR-amplified fragments (CAPS; Sheffield et al. (1993) Genomics 16:325-332), allele-specific ligation (Landegren et al. (1988) Science 241:1077-1080), nucleotide extension reactions (Sokolov (1990) Nucleic Acid Res. 18:3671), Radiation Hybrid Mapping (Walter et al. (1997) Nat. Genet. 7:22-28) and Happy Mapping (Dear and Cook (1989) Nucleic Acid Res. 17:6795-6807). For these methods, the sequence of a nucleic acid is used to design and produce primer pairs for use in the amplification reaction or in primer extension reactions. The design of such primers is well known to those skilled in the art. In methods employing PCR-based genetic mapping, it may be necessary to identify DNA sequence differences between the parents of the mapping cross in the region corresponding to the instant nucleic acid sequence. This, however, is generally not necessary for mapping methods.

Plant

The term "plant" as used herein encompasses whole plants, ancestors and progeny of the plants and plant parts, including seeds, shoots, stems, leaves, roots (including tubers), flowers, and tissues and organs, wherein each of the aforementioned comprise the gene/nucleic acid of interest. The term "plant" also encompasses plant cells, suspension cultures, callus tissue, embryos, meristematic regions, gametophytes, sporophytes, pollen and microspores, again wherein each of the aforementioned comprises the gene/nucleic acid of interest.

Plants that are particularly useful in the methods of the invention include all plants which belong to the superfamily Viridiplantae, in particular monocotyledonous and dicotyledonous plants including fodder or forage legumes, ornamental plants, food crops, trees or shrubs selected from the list comprising *Acer* spp., *Actinidia* spp., *Abelmoschus* spp., *Agave sisalana*, *Agropyron* spp., *Agrostis stolonifera*, *Allium* spp., *Amaranthus* spp., *Ammophila arenaria*, *Ananas comosus*, *Annona* spp., *Apium graveolens*, *Arachis* spp, *Artocarpus* spp., *Asparagus officinalis*, *Avena* spp. (e.g. *Avena sativa*, *Avena fatua*, *Avena byzantina*, *Avena* fatua var. *sativa*, *Avena hybrida*), *Averrhoa carambola*, *Bambusa* sp., *Benincasa hispida*, *Bertholletia excelsea*, *Beta vulgaris*, *Brassica* spp. (e.g. *Brassica napus*, *Brassica rapa* ssp. [canola, oilseed rape, turnip rape]), *Cadaba farinosa*, *Camellia sinensis*, *Canna indica*, *Cannabis sativa*, *Capsicum* spp., *Carex elata*, *Carica papaya*, *Carissa macrocarpa*, *Carya* spp., *Carthamus tinctorius*, *Castanea* spp., *Ceiba pentandra*, *Cichorium endivia*, *Cinnamomum* spp., *Citrullus lanatus*, *Citrus* spp., *Cocos* spp., *Coffea* spp., *Colocasia esculenta*, *Cola* spp., *Corchorus* sp., *Coriandrum sativum*, *Corylus* spp., *Crataegus* spp., *Crocus sativus*, *Cucurbita* spp., *Cucumis* spp., *Cynara* spp., *Daucus carota*, *Desmodium* spp., *Dimocarpus longan*, *Dioscorea* spp., *Diospyros* spp., *Echinochloa* spp., *Elaeis* (e.g. *Elaeis guineensis*, *Elaeis oleifera*), *Eleusine coracana*, *Eragrostis tef*, *Erianthus* sp., *Eriobotrya japonica*, *Eucalyptus* sp., *Eugenia uniflora*, *Fagopyrum* spp., *Fagus* spp., *Festuca arundinacea*, *Ficus carica*, *Fortunella* spp., *Fragaria* spp., *Ginkgo biloba*, *Glycine* spp. (e.g. *Glycine max*, *Soja hispida* or *Soja max*), *Gossypium hirsutum*, *Helianthus* spp. (e.g. *Helianthus annuus*), *Hemerocallis fulva*, *Hibiscus* spp., *Hordeum* spp. (e.g. *Hordeum vulgare*), *Ipomoea batatas*, *Juglans* spp., *Lactuca sativa*, *Lathyrus* spp., *Lens culinaris*, *Linum usitatissimum*, *Litchi chinensis*, *Lotus* spp., *Luffa acutangula*, *Lupinus* spp., *Luzula sylvatica*, *Lycopersicon* spp. (e.g. *Lycopersicon esculentum*, *Lycopersicon lycopersicum*, *Lycopersicon pyriforme*), *Macrotyloma* spp., *Malus* spp., *Malpighia emarginata*, *Mammea americana*, *Mangifera indica*, *Manihot* spp., *Manilkara zapota*, *Medicago sativa*, *Melilotus* spp., *Mentha* spp., *Miscanthus sinensis*, *Momordica* spp., *Morus nigra*, *Musa* spp., *Nicotiana* spp., *Olea* spp., *Opuntia* spp., *Ornithopus* spp., *Oryza* spp. (e.g. *Oryza sativa*, *Oryza latifolia*), *Panicum miliaceum*, *Panicum virgatum*, *Passiflora edulis*, *Pastinaca sativa*, *Pennisetum* sp., *Persea* spp., *Petroselinum crispum*, *Phalaris arundinacea*, *Phaseolus* spp., *Phleum pratense*, *Phoenix* spp., *Phragmites australis*, *Physalis* spp., *Pinus* spp., *Pistacia vera*, *Pisum* spp., *Poa* spp., *Populus* spp., *Prosopis* spp., *Prunus* spp., *Psidium* spp., *Punica granatum*, *Pyrus communis*, *Quercus* spp., *Raphanus sativus*, *Rheum rhabarbarum*, *Ribes* spp., *Ricinus communis*, *Rubus* spp., *Saccharum* spp., *Salix* sp., *Sambucus* spp., *Secale cereale*, *Sesamum* spp., *Sinapis* sp., *Solanum* spp. (e.g. *Solanum tuberosum*, *Solanum* integrifolium or *Solanum lycopersicum*), *Sorghum bicolor*, *Spinacia* spp., *Syzygium* spp., *Tagetes* spp., *Tamarindus indica*, *Theobroma cacao*, *Trifolium* spp., *Tripsacum dactyloides*, *Triticosecale rimpaui*, *Triticum* spp. (e.g. *Triticum aestivum*, *Triticum durum*, *Triticum turgidum*, *Triticum hybernum*, *Triticum macha*, *Triticum sativum*, *Triticum monococcum* or *Triticum vulgare*), *Tropaeolum minus*, *Tropaeolum majus*, *Vaccinium* spp., *Vicia* spp., *Vigna* spp., *Viola odorata*, *Vitis* spp., *Zea mays*, *Zizania palustris*, *Ziziphus* spp., amongst others.

Control Plant(s)

The choice of suitable control plants is a routine part of an experimental setup and may include corresponding wild type plants or corresponding plants without the gene of interest. The control plant is typically of the same plant species or even of the same variety as the plant to be assessed. The control plant may also be a nullizygote of the plant to be assessed. Nullizygotes are individuals missing the transgene by segregation. A "control plant" as used herein refers not only to whole plants, but also to plant parts, including seeds and seed parts.

DETAILED DESCRIPTION OF THE INVENTION

Surprisingly, it has now been found that modulating expression in a plant of one or more nucleic acid(s) encoding at least two iSYT polypeptides selected from the group consisting of any of the polypeptides of Table A, homologues thereof and fusions of the same gives plants having enhanced yield-related traits relative to control plants. According to a first embodiment, the present invention provides a method for enhancing yield-related traits in plants relative to control plants, comprising modulating expression in a plant of one or more nucleic acid(s) encoding at least two iSYT polypeptides selected from the group consisting of any of the polypeptides of Table A, homologues thereof and fusions of the same and optionally selecting for plants having enhanced yield-related traits.

A preferred method for modulating, increasing or decreasing expression of a nucleic acid encoding at least two iSYT polypeptides selected from the group consisting of any of the polypeptides of Table A, homologues thereof and fusions of the same is by introducing and expressing in a plant a nucleic acid encoding a iSYT-like polypeptide.

Any reference hereinafter to a "protein useful in the methods of the invention" is taken to mean an iSYT polypeptide, homologue thereof or fusions of the same as defined herein. Any reference hereinafter to a "nucleic acid useful in the methods of the invention" is taken to mean a nucleic acid capable of encoding such an iSYT polypeptide, homologue thereof or fusions of the same. The nucleic acid to be introduced into a plant (and therefore useful in performing the methods of the invention) is any nucleic acid encoding the type of protein which will now be described, hereafter also named "iSYT nucleic acid" or "iSYT gene".

An "iSYT polypeptide" as defined herein refers to any of the polypeptide of Table A and maybe represented by the corresponding amino acid sequence as provided in the sequence listing. Further description of an iSYT polypeptide is provided in Table B.

An "iSYT-like polypeptide" as defined herein refers to any polypeptide selected from the group consisting of any of the polypeptides of Table A, homologues thereof and fusions of the same.

Polypeptides useful in the methods of the invention are iSYT polypeptides as well as iSYT-like polypeptides.

A fusion of iSYT and/or iSYT-like polypeptides is preferably encoded by a nucleic acid which may be constructed using well known recombinant DNA techniques (Sambrook J, Fritsch E F and Maniatis T (1989) Molecular Cloning, A Laboratory Manual). For example the protein fusion may comprise a fusion of the entire iSYT and/or iSYT-like polypeptides or of only a portion of the same, for example the N-terminal or the C-terminal portion. Preferably the portion comprises one or more of the conserved domain corresponding to the domains of Tables C1 to C20 of the corresponding iSYT polypeptide.

Concerning SYT

SYT as defined herein refers to the polypeptide encoded by the AN3 (ANGUSTIFOLIA 3) gene of *Arabidopsis thaliana*. Alternative names for the AN3 gene are GIF1 gene and SYT1 gene. The genomic locus and the AGI reference of the SYT gene is AT5g28640.

The terms "SYT", "SYT1" and "AN3" as used herein are interchangeable.

A "SYT polypeptide" as referred herein is represented by the sequence:

(SEQ ID NO: 671)
MQQHLMQMQPMMAGYYPSNVTSDHIQQYLDENKSLILKIVESQNSGKLSE

CAENQARLQRNLMYLAAIADSQPQPPSVHSQYGSAGGGMIQGEGGSHYLQ

QQQATQQQMTQQSLMAARSSMLYAQQQQQQQPYATLQHQQLHHSQLGMS

SSSGGGGSSGLHILQGEAGGFHDFGRGKPEMGSGGGEGRGGSSGDGGET

LYLKSSDDGN

A "SYT Polypeptide" useful in the methods of the invention is preferably encoded by the following nucleic acid:

(SEQ ID NO: 672)
ATGCAACAGCACCTGATGCAGATGCAGCCCATGATGGCTGGTTACTACCC

CAGCAATGTTACCTCTGATCATATCCAACAGTACTTGGACGAAAACAAAT

CGTTGATTCTGAAGATTGTTGAGTCTCAAAACTCTGGAAAGCTTAGCGAA

TGCGCCGAGAATCAAGCAAGGCTTCAACGCAACCTAATGTACCTAGCTGC

AATAGCAGATTCTCAGCCTCAGCCACCAAGTGTGCATAGCCAGTATGGAT

CTGCTGGTGGTGGGATGATTCAGGGAGAAGGAGGGTCACACTATTTGCAG

CAGCAACAAGCGACTCAACAGCAACAGATGACTCAGCAGTCTCTAATGGC

GGCTCGATCTTCAATGTTGTATGCTCAGCAACAGCAGCAGCAGCAGCCTT

ACGCGACGCTTCAGCATCAGCAATTGCACCATAGCCAGCTTGGAATGAGC

TCGAGCAGCGGAGGAGGAGGAAGCAGTGGTCTCCATATCCTTCAGGGAGA

GGCTGGTGGGTTTCATGATTTTGGCCGTGGGAAGCCGGAAATGGGAAGTG

GTGGTGGCGGTGAAGGCAGAGGAGGAAGTTCAGGGGATGGTGGAGAAACC

CTTTACTTGAAATCATCAGATGATGGGAATTGA

Alternatively or additionally, the term "SYT polypeptide or homologue thereof" as defined herein refers to a polypeptide comprising an SNH domain having in increasing order of preference at least 40%, 45%, 50%, 55%, 60%, 65%, 70%, 75%, 80%, 85%, 90%, 91%, 92%, 93%, 94%, 95%, 96%, 97%, 98%, 99% sequence identity to the SNH domain of SEQ ID NO: 670.

SEQ ID NO: 670:
IQQYLDENKSLILKIVESQNSGKLSECAENQARLQRNLMYLAAIAD

Preferred homologues of a SYT polypeptide useful in the methods of the invention are listed in Table A2.

Preferably the methods of the invention concern a homologue of a SYT polypeptide derived from a crop plant more preferably, in increasing order of preference from corn, sugar cane, soybean, wheat, cotton and canola.

Additionally or alternatively, the homologue of a SYT polypeptide useful in the method in the invention has in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% overall sequence identity to the amino acid represented by any one of the polypeptide sequences of Table A2 or of the SYT Polypeptide. The overall sequence identity is determined using a global alignment algorithm, such as the Needleman Wunsch algorithm in the program GAP (GCG Wisconsin Package, Accelrys), preferably with default parameters and preferably with sequences of mature proteins (i.e. without taking into account secretion signals or transit peptides). Compared to overall sequence identity, the sequence identity will generally be higher when only conserved domains or motifs are considered.

Preferably an iSYT, a homologue thereof or a fusion of the same useful in the methods of the invention comprises a domain having in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to the amino acid sequence of one or more of the conserved domain located at specific amino acid coordinates of an iSYT polypeptide according to Tables C1 to C20, preferably to the domain identified in the HMMSmart database.

For Example, a homologue of the iSYT AT1G05370 polypeptide useful in the methods of the invention comprises a domain having in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity to the amino acid sequence of any one or more of the conserved domains according to Table C1, Preferably the methods of the invention concern a homologue of an iSYT polypeptide derived from a crop plant more preferably, in increasing order of preference from corn, sugar cane, soybean, wheat, cotton and canola.

The terms "domain", "signature" and "motif" are defined in the "definitions" section herein.

In one embodiment preferred combinations of two iSYT polypeptide whose expression is to be modulated according the methods of the invention are provided on Table 3. In another further preferred embodiment homologues of such iSYT polypeptides are combined, more preferably from a monocotyledoneous plant, more preferably from rice or corn plants.

TABLE 3

Combinations of two iSYT polypeptides.

| Combination | iSYT polypeptide 1 | ortholog of | iSYT polypeptide 2 | ortholog of |
|---|---|---|---|---|
| Combi1 | (AT5G28640) | | (AT1G18450) | |
| Combi2 | (AT5G28640) | | (AT3G60830) | |
| Combi3 | (AT5G28640) | | (AT2G46020) | |
| Combi4 | (AT5G28640) | | (AT2G28290) | |
| Combi5 | (AT5G28640) | | (AT1G21700) | |
| Combi6 | (AT5G28640) | | (AT5G14170) | |
| Combi7 | (AT5G28640) | | (AT1G23900) | |
| Combi8 | (AT5G28640) | | (AT2G18876) | |
| Combi9 | (AT5G28640) | | (AT4G27550) | |
| Combi10 | (AT5G28640) | | (AT1G65980) | |
| Combi11 | (AT5G28640) | | (AT1G05370) | |
| Combi12 | (AT5G28640) | | (AT4G35550) | |
| Combi13 | (AT5G28640) | | (AT4G21540) | |
| Combi14 | (AT5G28640) | | (AT1G20670) | |
| Combi15 | (AT2G46020) | | (AT2G28290) | |
| Combi16 | (AT5g23690) | | (AT3G60830) | |
| Combi17 | (AT3G60830) | | (AT1G18450) | |
| Combi18 | (AT4g17330) | | (AT2G46020) | |
| Combi19 | Poptr_importin beta | AT5G53480 | Poptr_importin alpha | AT3g06720 |
| Combi20 | Zeama_SYT1 | AT5G28640 | Zeama_SWIB/MDM2/CHC1 like protein | AT5G14170 |
| Combi21 | Zeama_SYT1 | AT5G28640 | Zeama_hypothetical protein, heme binding | AT5G17510 |
| Combi22 | Zeama_SYT1 | AT5G28640 | Poptr_ARP7 | AT3G60830 |
| Combi23 | Poptr_ARP7 | AT3G60830 | Poptr_ARP4 | AT1G18450 | preferably to the domain SM00516 located at amino acid coordinates 86-229 of the iSYT AT1 G05370 polypeptide.

Preferred homologues of an iSYT polypeptide useful in the methods of the invention are given in Tables A1 to A26.

Additionally or alternatively, the homologue of a iSYT polypeptide useful in the method in the invention has in increasing order of preference at least 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% overall sequence identity to the amino acid represented by any one of the polypeptide sequences selected from the group consisting of the polypeptides of Table A and Tables A1 to A26. The overall sequence identity is determined using a global alignment algorithm, such as the Needleman Wunsch algorithm in the program GAP (GCG Wisconsin Package, Accelrys), preferably with default parameters and preferably with sequences of mature proteins (i.e. without taking into account secretion signals or transit peptides). Compared to overall sequence identity, the sequence identity will generally be higher when only conserved domains or motifs are considered.

Encompassed on Table 4 are the corresponding orthologoues iSYT-like polypeptides originating from poplar or corn cells.

Another aspect of the invention is an isolated AN3-based protein complex, comprising at least the proteins AN3p and one or more of the proteins selected from the group encoded by AT4G16143, AT1G09270, AT3G06720, AT5G53480, AT3G60830, AT1G18450, AT2G46020, AT2G28290, AT1G21700, AT5G14170, AT4G17330, AT4G27550, AT1G65980, AT5G55210, AT3G15000, AT4G35550, AT1G20670, AT1G08730, AT5G13030, AT2G18876, AT5G17510, AT1G05370, AT4G21540, AT1G23900 and AT5G23690 (genes listed in Table A). Preferably, said AN3-based protein complex comprises at least the proteins AN3p and one or more proteins selected from the group consisting of ARP4 (AT1G18450), ARP7 (AT3G60830), SNF2 (AT2G46020), SYD (AT2G28290), SWI3C (AT1G21700) and SWP73B (AT5G14170). Even more preferably, said AN3-based protein complex comprises at least AN3p, an actin related protein selected from the group consisting of ARP4 and ARP7, an ATPase selected from the group consisting of SNF2 (BRM) and SYD and a SWIRM domain containing protein. Preferably, said SWIRM domain containing protein is SWI3C. An AN3-based protein complex as used here means that AN3p is interacting, directly or indirectly, with the other proteins of the complex. A direct interaction is an interaction where at least one domain of AN3p interacts with one or more domains or the interaction partner. An indirect interaction is an interaction where AN3p itself is not interacting with the interacting protein by one of its domains, but where said interacting protein is interacting with a protein that is directly or indirectly interacting with AN3p.

A further aspect of the invention is the use of a protein complex according to the invention to promote plant growth. Preferably, said use is an overexpression of the protein complex, by overexpressing at least two members of the protein complex. Promotion of plant growth, as used here, is an increase in plant biomass in plants where the protein complex is used, compared with the same plant where the complex is not used, grown under the same conditions, except for the conditions needed for the use of the complex, if any. Such conditions may be, as a non limited example, the addition of one or more compounds to induce one or more promoters of one or more genes encoding a protein of the complex. Alternatively, the same plant is an untransformed parental plant, grown under the same conditions as the transformed plant, wherein the complex is used. Preferably, promotion of plant growth results in an increased yield. This yield can be a total increase in plant biomass, or a partial increase of yield, such as, but not limited to seed yield, leave yield or root yield.

Still another aspect of the invention is a method to promote AN3-based protein complex formation, by simultaneous overexpression of at least two proteins of the complex. Proteins of the complex, beside AN3p itself, are listed in table A. Preferably, said overexpression is an overexpression of AN3p and one or more proteins selected from the group consisting of ARP4 (AT1G18450), ARP7 (AT3G60830), SNF2 (AT2G46020), SYD (AT2G28290), SWI3C (AT1G21700) and SWP73B (AT5G14170). Even more preferably, said overexpression is an overexpression of at least AN3p, an actin related protein selected from the group consisting of ARP4 and ARP7, an ATPase selected from the group consisting of SNF2 (BRM) and SYD and a SWIRM domain containing protein. Preferably, said SWIRM domain containing protein is SWI3C.

Methods for obtaining overexpression are known to the person skilled in the art, and comprise, but are not limited to placing the gene encoding the protein to be overexpressed after a strong promoter such as the Cauliflower Mosaic Virus $^{35}$S promoter. Simultaneous overexpression as used here means that there is an overlap in timeframe for all the proteins to be overexpressed, whereby the level of said proteins is increased when compared to a non-overexpressed control. It does not necessarily mean that all genes should be induced at the same moment. Depending upon the turnover of the messenger RNA and/or the protein, one gene may be induced before or after another, as long as there is an overlap in time where both proteins are present in a concentration that is higher than the normal (non-overexpressed) concentration.

In addition, two or three iSYT-like polypeptides, when expressed in rice according to the methods of the present invention as outlined in the Examples section, give plants having increased yield related traits, selected from increased aboveground biomass or increased seed yield.

The present invention is illustrated by transforming plants with the nucleic acid sequences comprising the gene encoding the combinations of the polypeptides of Table 4. However, performance of the invention is not restricted to these sequences; the methods of the invention may advantageously be performed using any iSYT-like-encoding nucleic acid or iSYT-like polypeptide as defined herein.

Examples of nucleic acids encoding iSYT-like polypeptides are given in Table A an Tables A2 to A26 of the Examples section herein. Such nucleic acids are useful in performing the methods of the invention. The amino acid sequences given in Tables A2 to A26 of the Examples section are example sequences of orthologues and paralogues of the iSYT polypeptide of Table A, the terms "orthologues" and "paralogues" being as defined herein. Further orthologues and paralogues may readily be identified by performing a so-called reciprocal blast search as described in the definitions section; where the query sequence is SEQ ID NO: 1 or SEQ ID NO: 2, the second BLAST (back-BLAST) would be against *Arabidopsis thaliana* sequences.

The invention also provides hitherto unknown iSYT-encoding nucleic acids and iSYT polypeptides useful for conferring enhanced yield-related traits in plants relative to control plants.

According to a further embodiment of the present invention, there is therefore provided an isolated nucleic acid molecule selected from:
  (i) a nucleic acid represented by any one of the polynucleotides of Tables A2 to A26;
  (ii) the complement of a nucleic acid of (i);
  (iii) a nucleic acid encoding an iSYT-like polypeptide having in increasing order of preference at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% 99% or 100% sequence identity to the amino acid sequence of any of the polypeptides of Table A2 to A26 and further preferably conferring enhanced yield-related traits relative to control plants.
  (iv) a nucleic acid molecule which hybridizes with a nucleic acid molecule of (i) to (iii) under high stringency hybridization conditions and preferably confers enhanced yield-related traits relative to control plants.

According to a further embodiment of the present invention, there is also provided an isolated polypeptide selected from:
  (i) an amino acid sequence represented by any one of the polypeptides of Tables A2 to A26;
  (ii) an amino acid sequence having, in increasing order of preference, at least 50%, 51%, 52%, 53%, 54%, 55%, 56%, 57%, 58%, 59%, 60%, 81%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or 99% sequence identity to the amino acid sequence of any of the sequences of the polypeptide of Table A2 to A26 and further preferably conferring enhanced yield-related traits relative to control plants.
  (iii) derivatives of any of the amino acid sequences given in (i) or (ii) above.

Nucleic acid variants may also be useful in practising the methods of the invention. Examples of such variants include nucleic acids encoding homologues and derivatives of any one of the amino acid sequences given in Table A of the Examples section, the terms "homologue" and "derivative" being as defined herein. Also useful in the methods of the invention are nucleic acids encoding homologues and derivatives of orthologues or paralogues of any one of the amino acid sequences given in Table A of the Examples section. Homologues and derivatives useful in the methods of the present invention have substantially the same biological and functional activity as the unmodified protein from which they are derived. Further variants useful in practising the methods of the invention are variants in which codon usage is optimised or in which miRNA target sites are removed.

Further nucleic acid variants useful in practising the methods of the invention include portions of nucleic acids encoding iSYT-like polypeptides, nucleic acids hybridising to nucleic acids encoding iSYT-like polypeptides, splice variants of nucleic acids encoding iSYT-like polypeptides, allelic variants of nucleic acids encoding iSYT-like polypeptides and variants of nucleic acids encoding iSYT-like polypeptides obtained by gene shuffling. The terms hybridising sequence, splice variant, allelic variant and gene shuffling are as described herein.

Nucleic acids encoding iSYT-LIKE polypeptides need not be full-length nucleic acids, since performance of the methods of the invention does not rely on the use of full-length nucleic acid sequences. According to the present invention, there is provided a method for enhancing yield-related traits in plants, comprising introducing and expressing in a plant a portion of any one of the nucleic acid sequences given in Table A of the Examples section, or a portion of a nucleic acid encoding an orthologue, paralogue or homologue of any of the amino acid sequences given in Table A of the Examples section wherein the nucleic acid encodes two or three iSYT polypeptides.

A portion of a nucleic acid may be prepared, for example, by making one or more deletions to the nucleic acid. The portions may be used in isolated form or they may be fused to other coding (or non-coding) sequences in order to, for example, produce a protein that combines several activities. When fused to other coding sequences, the resultant polypeptide produced upon translation may be bigger than that predicted for the protein portion.

Portions useful in the methods of the invention, encode a iSYT-like polypeptide as defined herein, and have substantially the same biological activity as the amino acid sequences given in Table A of the Examples section. Preferably, the portion is a portion of any one of the nucleic acids given in Table A of the Examples section, or is a portion of a nucleic acid encoding an orthologue or paralogue of any one of the amino acid sequences given in Table A of the Examples section. Preferably the portion is at least 100, 200, 300, 400, 500, 550, 600, 650, 700, 750, 800, 850, 900, 950, 1000 consecutive nucleotides in length, the consecutive nucleotides being of any one of the nucleic acid sequences given in Table A of the Examples section, or of a nucleic acid encoding an orthologue or paralogue of any one of the amino acid sequences given in Table A of the Examples section. Most preferably the portion is a portion of the nucleic acid of SEQ ID NO: 1.

Another nucleic acid variant useful in the methods of the invention is a nucleic acid capable of hybridising, under reduced stringency conditions, preferably under stringent conditions, with a nucleic acid encoding a iSYT-LIKE polypeptide as defined herein, or with a portion as defined herein.

Hybridising sequences useful in the methods of the invention encode an iSYT-LIKE polypeptide as defined herein, having substantially the same biological activity as the amino acid sequences given in Table A of the Examples section. Preferably, the hybridising sequence is capable of hybridising to the complement of any one of the nucleic acids given in Table A of the Examples section, or to a portion of any of these sequences, a portion being as defined above, or the hybridising sequence is capable of hybridising to the complement of a nucleic acid encoding an orthologue or paralogue of any one of the amino acid sequences given in Table A of the Examples section. Most preferably, the hybridising sequence is capable of hybridising to the complement of a nucleic acid encoding any of the polypeptide of Table A and Table A2 to A6.

Another nucleic acid variant useful in the methods of the invention is a splice variant encoding a iSYT-LIKE polypeptide as defined hereinabove, a splice variant being as defined herein.

According to the present invention, there is provided a method for enhancing yield-related traits in plants, comprising introducing and expressing in a plant a splice variant of two or three nucleic acid sequences given in Table A or Tables A2 to A26 of the Examples section, or a splice variant of a nucleic acid encoding an orthologue, paralogue or homologue of any of the amino acid sequences given in Table A of the Examples section.

Another nucleic acid variant useful in performing the methods of the invention is an allelic variant of a nucleic acid encoding an iSYT-LIKE polypeptide as defined hereinabove, an allelic variant being as defined herein.

According to the present invention, there is provided a method for enhancing yield-related traits in plants, comprising introducing and expressing in a plant of two or three allelic variant of any one of the nucleic acids given in Table A or Tables A2 to A26 of the Examples section, or comprising introducing and expressing in a plant an allelic variant of a nucleic acid encoding an orthologue, paralogue or homologue of any of the amino acid sequences given in Table A of the Examples section.

Gene shuffling or directed evolution may also be used to generate variants of nucleic acids encoding iSYT-LIKE polypeptides as defined above; the term "gene shuffling" being as defined herein.

According to the present invention, there is provided a method for enhancing yield-related traits in plants, comprising introducing and expressing in a plant a variant of any one of the nucleic acid sequences given in Table A or Tables A2 to A26 of the Examples section, or comprising introducing and expressing in a plant a variant of a nucleic acid encoding two or three orthologue, paralogue or homologue of any of the amino acid sequences given in Table A or Tables A2 to A26 of the Examples section, which variant nucleic acid is obtained by gene shuffling.

Furthermore, nucleic acid variants may also be obtained by site-directed mutagenesis. Several methods are available to achieve site-directed mutagenesis, the most common being PCR based methods (Current Protocols in Molecular Biology. Wiley Eds.).

Nucleic acids encoding iSYT-like polypeptides may be derived from any natural or artificial source. The nucleic acid may be modified from its native form in composition and/or genomic environment through deliberate human manipulation. Preferably the iSYT-LIKE polypeptide-encoding nucleic acid is from a plant, further preferably from a monocotyledonous plant, most preferably the nucleic acid is from *Zea mays* or from *Oryza sativa*.

Performance of the methods of the invention gives plants having enhanced yield-related traits. In particular performance of the methods of the invention gives plants having increased yield, especially increased seed yield relative to control plants. The terms "yield" and "seed yield" are described in more detail in the "definitions" section herein.

Reference herein to enhanced yield-related traits is taken to mean an increase early vigour and/or in biomass (weight) of one or more parts of a plant, which may include aboveground (harvestable) parts and/or (harvestable) parts below ground. In particular, such harvestable parts are seeds, and performance of the methods of the invention results in plants having increased seed yield relative to the seed yield of control plants.

A preferred method for modulating (increasing or decreasing) expression of any two or three nucleic acids encoding the corresponding two or three iSYT-like polypeptides is by introducing and expressing in a plant: (i) a nucleic acid sequence encoding a first iSYT-like polypeptide; and (ii) a nucleic acid sequence encoding a second iSYT-like polypeptide. Therefore, according to the present invention, there is provided a method for enhancing yield-related traits in plants, which method comprises introducing and expressing in a plant:
  (i) any two or three nucleic acids encoding the corresponding two or three iSYT-like polypeptides; or
  (ii) two or three nucleic acids, each encoding a single iSYT-like polypeptide; or
  (iii) a nucleic acid according to (i) and a nucleic according to (ii),
wherein said iSYT-like polypeptide is selected from the group consisting of any of the polypeptides of Table A, homologues thereof and fusions of the same.

Methods for introducing and expressing two or more transgenes (also called gene stacking) in transgenic plants are well known in the art (see for example, a review by Halpin (2005) Plant Biotech J (3): 141-155. Gene stacking can proceed by interative steps, where two or more transgenes can be sequentially introduced into a plant by crossing a plant containing one transgene with individuals harbouring other transgenes or, alternatively, by re-transforming (or super-transforming) a plant containing one transgene with new genes.

According to the present invention, there is provided a method for enhancing yield-related traits in plants, which method comprises sequentially introducing and expressing in a plant:
  (i) any two or three nucleic acids encoding the corresponding two or three iSYT-like polypeptides; or
  (ii) two or three nucleic acids, each encoding a single iSYT-like polypeptide; or
  (iii) a nucleic acid according to (i) and a nucleic according to (ii), wherein said iSYT-like polypeptide is selected from the group consisting of any of the polypeptides of Table A, homologues thereof and fusions of the same.

Preferably, the nucleic acid sequences of (i), (ii) and (iii) are sequentially introduced and expressed by crossing. A crossing is performed between a female parent plant comprising an introduced and expressed isolated nucleic acid sequence encoding one or two iSYT-like polypeptides, and a male parent plant also comprising an introduced and expressed isolated nucleic acid sequence encoding one or two iSYT-like polypeptides, and preferably selecting in the progeny for the presence and expression of both transgenes. Therefore, according to the present invention, there is provided a method for enhancing yield-related traits in plants, by crossing a female parent plant comprising an introduced and expressed isolated nucleic acid sequence encoding one or two iSYT-like polypeptides, and a male parent plant comprising an introduced and expressed isolated nucleic acid sequence encoding one or two iSYT-like polypeptides, and preferably selecting in the progeny for the presence and expression of at least two of the introduced transgenes encoding the corresponding iSYT-like polypeptides, wherein said plants have enhanced yield-related traits relative to the parent plants, or to any other control plants as defined herein.

Alternatively the nucleic acid sequences of (i), (ii) and (iii) are sequentially introduced and expressed by re-transformation. Re-transformation is performed by introducing and expressing a nucleic acid sequence encoding one or two iSYT-like polypeptides, plant part, or plant cell comprising a introduced and expressed nucleic acid sequence encoding a second one or two iSYT-like polypeptides, and preferably by selecting in the progeny for the presence and expression of both transgenes. Therefore, according to the present invention, there is provided a method for enhancing yield-related traits in plants, by re-transformation performed by introducing and expressing a nucleic acid sequence encoding one or two iSYT-like polypeptides into a plant, plant part, or plant cell comprising an introduced and expressed nucleic acid sequence encoding a second one or two iSYT-like polypeptide, and by preferably selecting in the progeny for the presence and expression of both transgenes, wherein said plants have enhanced yield-related traits relative to the plants having increased expression of one of:
  (i) any two or three nucleic acids encoding the corresponding two or three iSYT-like polypeptides; or
  (ii) two or three nucleic acids, each encoding a single iSYT-like polypeptide; or
  (iii) a nucleic acid according to (i) and a nucleic according to (ii),
wherein said iSYT-like polypeptide is selected from the group consisting of any of the polypeptides of Table A, homologues thereof and fusions of the same.

Alternatively, gene stacking can occur via simultaneous transformation, or co-transformation, which is faster and can be used in a whole range of well known transformation techniques, preferably as described herein.

Alternatively, gene stacking can occur via simultaneous transformation, or co-transformation, which is faster and can be used in a whole range of transformation techniques, as described in the "definition" section herein.

When direct genetic transformation is considered, using physical or chemical delivery systems (e.g., microprojectile bombardment, PEG, electroporation, liposome, glass needles, etc.), the transgenes (at least two) can also be present in a number of conformations, but essentially do not need to be comprised in a vector capable of being replicated in *Agrobacteria* or viruses, intermediates of the genetic transformation. The two transgenes can be comprised in one or more nucleic acid molecules, but simultaneously used for the genetic transformation process.

According to the present invention, there is provided a method for enhancing yield-related traits in plants, which method comprises simultaneously introducing and expressing in a plant: (i) a nucleic acid sequence encoding one or two iSYT-like polypeptides; and (ii) a nucleic acid sequence encoding a second iSYT-like polypeptide, which plants have enhanced yield-related traits relative to plants having increased expression of one of:
  (i) any two or three nucleic acids encoding the corresponding two or three iSYT-like polypeptides; or
  (ii) two or three nucleic acids, each encoding a single iSYT-like polypeptide; or
  (iii) a nucleic acid according to (i) and a nucleic according to (ii),
wherein said iSYT-like polypeptide is selected from the group consisting of any of the polypeptides of Table A, homologues thereof and fusions of the same.

The nucleic acid sequences of (i), (ii) and (iii) that are simultaneously introduced and expressed, are comprised in one or more nucleic acid molecules. Therefore, according to the present invention is provided increasing yield-related traits in plants, which method comprises simultaneously introducing and expressing in a plant:

(i) any two or three nucleic acids encoding the corresponding two or three iSYT-like polypeptides; or
(ii) two or three nucleic acids, each encoding a single iSYT-like polypeptide; or
(iii) a nucleic acid according to (i) and a nucleic according to (ii), wherein said iSYT-like polypeptide is selected from the group consisting of any of the polypeptides of Table A, homologues thereof and fusions of the same.

The invention also provides genetic constructs and vectors to facilitate introduction and/or expression (de novo introduced or increased the already existing expression) in plants of any two or three nucleic acids encoding the corresponding combination of two or three iSYT-like polypeptides. The gene constructs may be inserted into vectors, which may be commercially available, suitable for transforming into plants and for expression of the gene of interest in the transformed cells. The invention also provides use of a gene construct as defined herein in the methods of the invention.

More specifically, the present invention provides a construct comprising:
(a) any two or three nucleic acids encoding the corresponding two or three iSYT-like polypeptides as defined above;
(b) one or more control sequences capable of increasing expression of the nucleic acid sequence of (a) and of (b); and optionally
(c) a transcription termination sequence.

The nucleic acid sequence of (a) is preferably a nucleic acid molecule comprising a nucleic acid sequence encoding combinations of two or three iSYT-like polypeptides, preferably those combinations listed in Table 3. The nucleic acid sequences encoding the iSYT polypeptides in maybe fused to each other or separated by coding or non-coding DNA, such as promoters, introns, subcellular targeting signal, or stuffed DNA such as the MARs (Matrix attachment Regions) regions.

The term "control sequence" and "termination sequence" are as defined herein. Preferred control sequence of a construct useful in the methods of the invention are provided in Table 4, preferably as represented by SEQ ID NO: 665 to SEQ ID NO: 669.

Preferably, one of the control sequences of a construct is a constitutive promoter. An example of a constitutive promoter is a GOS2 promoter, preferably a rice GOS2 promoter, more preferably a GOS2 promoter as represented by SEQ ID NO: 664.

TABLE 4

Preferred promoters

| Promoter name | Source organism | SEQ ID NO |
|---|---|---|
| GOS2 | Oryza sativa | 665 |
| HMGB | Oryza sativa | 666 |
| ScBV | Sugarcane bacilliform virus | 667 |
| ScBV-METI | Sugarcane bacilliform virus with intron | 668 |
| ZmUBI | Zea mays | 669 |

In one preferred construct, a single control sequence is used to drive the expression of the nucleic acid sequence encoding two or three iSYT-like polypeptides, preferably those combinations as listed in Table 3.

The present invention also provides for a mixture of constructs useful for example, for simultaneous introduction and expression in plants of two or three nucleic acid sequence encoding an iSYT-like polypeptide as defined above; wherein at least one construct comprises:
(a) a nucleic acid sequence nucleic acid sequence encoding an iSYT-like polypeptide as defined above;
(b) one or more control sequences capable of driving expression of the nucleic acid sequence of (a); and optionally
(c) a transcription termination sequence, and wherein at least one other construct comprises:
(d) a nucleic acid sequence nucleic acid sequence encoding an iSYT-like polypeptide as defined above;
(e) one or more control sequences capable of driving expression of the nucleic acid sequence of (d); and optionally
(f) a transcription termination sequence.

Preferably, one of the control sequences of a construct is a constitutive promoter. An example of a constitutive promoter is a GOS2 promoter, preferably a rice GOS2 promoter, more preferably a GOS2 promoter as represented by SEQ ID NO: 664

The invention also provides for the use of a construct comprising: (a) any two or three nucleic acids encoding the corresponding two or three iSYT-like polypeptides as defined above, or of a mixture of constructs as described above, in a method for making plants having enhanced yield-related traits relative to plants having increased expression of one of the nucleic acids encoding the corresponding two or three iSYT-like polypeptides which increased yield-related traits are one or more of: (i) increased early vigour; (ii) increased aboveground biomass or root biomass; (iii) increased total seed yield per plant; (iv) increased seed filling rate; (v) increased number of (filled) seeds; (vi) increased harvest index; or (vii) increased thousand kernel weight (TKW).

The invention also provides for plants, plant parts or plant cells transformed with a construct comprising any two or three nucleic acids encoding the corresponding two or three iSYT-like polypeptides as defined above or with a mixture of constructs as defined above.

Plants are transformed with one or more vectors comprising any of the nucleic acid sequences described above. The skilled artisan is well aware of the genetic elements that must be present on the vector in order to successfully transform, select and propagate host cells containing the sequence of interest. The sequence of interest is operably linked to one or more control sequences (at least to a promoter).

Advantageously, any type of promoter, whether natural or synthetic, may be used to increase expression of the nucleic acid sequence. A constitutive promoter is particularly useful in the methods.

Other organ-specific promoters, for example for preferred expression in leaves, stems, tubers, meristems, seeds (embryo and/or endosperm), are useful in performing the methods of the invention. See the "Definitions" section herein for definitions of the various promoter types.

The present invention provides a method for enhancing yield-related traits especially seed yield of plants, relative to control plants, which method comprises modulating expression in a plant of a nucleic acid encoding a iSYT-LIKE polypeptide as defined herein.

Since the transgenic plants according to the present invention have increased yield (yield related traits), it is likely that these plants exhibit an increased growth rate (during at least part of their life cycle), relative to the growth rate of control plants at a corresponding stage in their life cycle.

According to a preferred feature of the present invention, performance of the methods of the invention gives plants having an increased growth rate relative to control plants.

Therefore, according to the present invention, there is provided a method for increasing the growth rate of plants, which method comprises modulating expression in a plant of a nucleic acid encoding a iSYT-like polypeptide as defined herein.

Performance of the methods of the invention gives plants grown under non-stress conditions or under mild drought conditions increased yield relative to control plants grown under comparable conditions. Therefore, according to the present invention, there is provided a method for increasing yield in plants grown under non-stress conditions or under mild drought conditions, which method comprises modulating expression in a plant of a nucleic acid encoding an iSYT-like polypeptide.

Performance of the methods of the invention gives plants grown under conditions of nutrient deficiency, particularly under conditions of nitrogen deficiency, increased yield relative to control plants grown under comparable conditions. Therefore, according to the present invention, there is provided a method for increasing yield in plants grown under conditions of nutrient deficiency, which method comprises modulating expression in a plant of a nucleic acid encoding an iSYT-like polypeptide.

Performance of the methods of the invention gives plants grown under conditions of salt stress, increased yield relative to control plants grown under comparable conditions. Therefore, according to the present invention, there is provided a method for increasing yield in plants grown under conditions of salt stress, which method comprises modulating expression in a plant of a nucleic acid encoding an iSYT-Like polypeptide.

The invention also provides genetic constructs and vectors to facilitate introduction and/or expression in plants of nucleic acids encoding iSYT-Like polypeptides. The gene constructs may be inserted into vectors, which may be commercially available, suitable for transforming into plants and suitable for expression of the gene of interest in the transformed cells. The invention also provides use of a gene construct as defined herein in the methods of the invention.

As mentioned above, a preferred method for modulating expression of a nucleic acid encoding a iSYT-Like polypeptide is by introducing and expressing in a plant a nucleic acid encoding a iSYT-Like polypeptide; however the effects of performing the method, i.e. enhancing yield-related traits may also be achieved using other well known techniques, including but not limited to T-DNA activation tagging, TILLING, homologous recombination. A description of these techniques is provided in the definitions section.

The present invention clearly extends to any plant cell or plant produced by any of the methods described herein, and to all plant parts and propagules thereof. The present invention encompasses plants or parts thereof (including seeds) obtainable by the methods according to the present invention. The plants or parts thereof comprise a nucleic acid transgene encoding a iSYT-Like polypeptide as defined above. The present invention extends further to encompass the progeny of a primary transformed or transfected cell, tissue, organ or whole plant that has been produced by any of the aforementioned methods, the only requirement being that progeny exhibit the same genotypic and/or phenotypic characteristic(s) as those produced by the parent in the methods according to the invention.

The invention also includes host cells containing an isolated nucleic acid encoding an iSYT-like polypeptide as defined hereinabove. Preferred host cells according to the invention are plant cells. Host plants for the nucleic acids or the vector used in the method according to the invention, the expression cassette or construct or vector are, in principle, advantageously all plants, which are capable of synthesizing the polypeptides used in the inventive method.

The methods of the invention are advantageously applicable to any plant. Plants that are particularly useful in the methods of the invention include all plants which belong to the superfamily Viridiplantae, in particular monocotyledonous and dicotyledonous plants including fodder or forage legumes, ornamental plants, food crops, trees or shrubs. According to a preferred embodiment of the present invention, the plant is a crop plant. Examples of crop plants include soybean, sunflower, canola, alfalfa, rapeseed, linseed, cotton, tomato, potato and tobacco. Further preferably, the plant is a monocotyledonous plant. Examples of monocotyledonous plants include sugarcane. More preferably the plant is a cereal. Examples of cereals include rice, maize, wheat, barley, millet, rye, triticale, sorghum, emmer, spelt, secale, einkorn, teff, milo and oats.

The invention also extends to harvestable parts of a plant such as, but not limited to seeds, leaves, fruits, flowers, stems, roots, rhizomes, tubers and bulbs, which harvestable parts comprise a recombinant nucleic acid encoding an iSYT-like polypeptide. The invention furthermore relates to products derived, preferably directly derived, from a harvestable part of such a plant, such as dry pellets or powders, oil, fat and fatty acids, starch or proteins.

The present invention also encompasses use of nucleic acids encoding iSYT-like polypeptides as described herein and use of these iSYT-like polypeptides in enhancing any of the aforementioned yield-related traits in plants. For example, nucleic acids encoding iSYT-like polypeptide described herein, or the iSYT-like polypeptides themselves, may find use in breeding programmes in which a DNA marker is identified which may be genetically linked to a iSYT-like polypeptide-encoding gene. The nucleic acids/genes, or the iSYT-like polypeptides themselves may be used to define a molecular marker. This DNA or protein marker may then be used in breeding programmes to select plants having enhanced yield-related traits as defined hereinabove in the methods of the invention. Furthermore, allelic variants of a iSYT-like polypeptide-encoding nucleic acid/gene may find use in marker-assisted breeding programmes. Nucleic acids encoding iSYT-like polypeptides may also be used as probes for genetically and physically mapping the genes that they are a part of, and as markers for traits linked to those genes. Such information may be useful in plant breeding in order to develop lines with desired phenotypes.

Items

The present invention will now be described in reference to the embodiments of the following items:

1. A method for enhancing yield-related traits in a plant relative to control plants, comprising modulating expression in a plant of:
   (i) any two or three nucleic acids encoding the corresponding two or three iSYT-like polypeptides; or
   (ii) two or three nucleic acids, each encoding a single iSYT-like polypeptide; or
   (iii) a nucleic acid according to (i) and a nucleic according to (ii),
   wherein said iSYT-like polypeptide is selected from the group consisting of any of the polypeptides of Table A, homologues thereof and fusions of the same.

2. A method according to item 1 wherein at least one of the polypeptides is a synovial sarcoma translocation (SYT) polypeptide or a homologue thereof, said SYT polypeptide or homologue thereof preferably comprising an SNH domain having in increasing order of preference at least 40%, 45%, 50%, 55%, 60%, 65%, 70%, 75%, 80%, 85%, 90%, 91%, 92%, 93%, 94%, 95%, 96%, 97%, 98%, 99% sequence identity to the SNH domain of SEQ ID NO: 670 (IQQYLDENKSLILKIVESQNSGKLSE-CAENQARLQRNL MYLAAIAD).

3. A method according to item 1 or 2 wherein said nucleic acids encode the corresponding polypeptides selected from the group consisting of the polypeptides listed in Table 3.

4. Method according to any one of items 1 to 3, wherein said modulated expression is effected by introducing and expressing in a plant said nucleic acids.

5. Method according to any one of items 1 to 4, wherein said nucleic acids is selected from the group consisting of the nucleic acids encoding any the proteins listed in Table A and Tables A2 to Table A26, or is a portion of such a nucleic acid, or a nucleic acid capable of hybridising with such a nucleic acid.

6. Method according to any one of items 1 to 5, wherein said nucleic acids encode an orthologue or paralogue of any of the proteins given in Table A.

7. Method according to any preceding item, wherein said enhanced yield-related traits comprise increased yield, preferably increased biomass and/or increased seed yield relative to control plants.

8. Method according to any preceding item, wherein said enhanced yield-related traits are obtained under non-stress conditions.

9. Method according to any preceding item, wherein said enhanced yield-related traits are obtained under conditions of drought stress, salt stress or nitrogen deficiency.

10. Method according to any one of items 4 to 9, wherein said one or more said nucleic acids are operably linked to a plant promoter, preferably to a constitutive promoter, more preferably to a GOS2 promoter, most preferably to a GOS2 promoter from rice.

11. Method according to any one of items 1 to 10, wherein said one or more said nucleic acids is of plant origin, preferably from a dicotyledonous plant, further preferably from the family Brassicaceae, more preferably from the genus *Arabidopsis*, most preferably from *Arabidopsis thaliana*.

12. Plant or part thereof, including seeds, obtainable by a method according to any one of items 1 to 11, wherein said plant or part thereof comprises any two or three nucleic acids encoding the corresponding two or three polypeptides selected from the group consisting of the polypeptides listed in Table A, homologues thereof and fusions of the same.

13. Construct comprising:
    (i) Any two or three nucleic acids encoding the corresponding two or three polypeptides selected from the group consisting of any of the polypeptides listed in of Table A or homologues thereof and fusions of the same;
    (ii) one or more control sequences capable of driving expression of the nucleic acid sequence of (i), preferably a plant promoter, more preferably a constitutive promoter, even more preferably a GOS2 promoter, most preferably a GOS2 promoter from rice; and optionally
    (iii) a transcription termination sequence.

14. Construct according to item 12, wherein said nuclec acid of (i) encodes two or three polypeptides selected from the group consisting of the polypeptides listed in Table 3.

15. Use of a construct according to item 13 or 14 in a method for making plants having increased yield, particularly increased biomass and/or increased seed yield relative to control plants.

16. Plant, plant part or plant cell transformed with a construct according to item 13 or 14.

17. Method for the production of a transgenic plant having increased yield, particularly increased biomass and/or increased seed yield relative to control plants, comprising:
    (i) introducing and expressing in a plant any two or three nucleic acids encoding the corresponding polypeptides selected from the group consisting of any of the polypeptides of Table A or homologues thereof and fusions of the same; and
    (ii) cultivating the plant cell under conditions promoting plant growth and development.

18. Transgenic plant having increased yield, particularly increased biomass and/or increased seed yield, relative to control plants, resulting from modulated expression of any two or three nucleic acids encoding the corresponding polypeptides selected from the group consisting of any of the polypeptides of Table A or homologues thereof and fusions of the same, or a transgenic plant cell derived from said transgenic plant.

19. Transgenic plant according to item 12, 16 or 18, or a transgenic plant cell derived thereof, wherein said plant is a crop plant or a monocot or a cereal, such as rice, maize, wheat, barley, millet, rye, triticale, sorghum emmer, spelt, secale, einkorn, teff, milo and oats.

20. Harvestable parts of a plant according to item 19, wherein said harvestable parts are preferably shoot biomass and/or seeds.

21. Products derived from a plant according to item 18 or 19 and/or from harvestable parts of a plant according to item 20.

22. Construct according to item 12, wherein said nuclec acid of (i) encodes two polypeptides selected from the group consisting of the combinations of Table 3.

23. Use of a construct according to item 13 or 14 in a method for making plants having increased yield, particularly increased biomass and/or increased seed yield relative to control plants.

24. Plant, plant part or plant cell transformed with a construct according to item 13 or 14.

25. Method for the production of a transgenic plant having increased yield, particularly increased biomass and/or increased seed yield relative to control plants, comprising:
    (iii) introducing and expressing in a plant one or more (isolated) nucleic acids encoding at least one, preferably two, three, four, five, six, seven, eight, nine, ten or more polypeptides selected from the group consisting of any of the polypeptides of Table A, homologues thereof and fusions of the same; and
    (iv) cultivating the plant cell under conditions promoting plant growth and development.

26. Transgenic plant having increased yield, particularly increased biomass and/or increased seed yield, relative to control plants, resulting from modulated expression of one or more (isolated) nucleic acids encoding at least one, preferably two, three, four, five, six, seven, eight, nine, ten or more polypeptides selected from the group consisting of any of the polypeptides of Table A, homologues thereof and fusions of the same, or a transgenic plant cell derived from said transgenic plant.

27. Transgenic plant according to item 12, 16 or 18, or a transgenic plant cell derived thereof, wherein said plant is a crop plant or a monocot or a cereal, such as rice, maize, wheat, barley, millet, rye, triticale, sorghum emmer, spelt, secale, einkorn, teff, milo and oats.

28. Harvestable parts of a plant according to item 19, wherein said harvestable parts are preferably shoot biomass and/or seeds.
29. Products derived from a plant according to item 18 or 19 and/or from harvestable parts of a plant according to item 20.
30. Use of any two or three nucleic acids encoding two or three polypeptides selected from the group consisting of any of the polypeptides of Table A, homologues thereof and fusions of the same in increasing yield, particularly in increasing seed yield and/or shoot biomass in plants, relative to control plants.
31. An isolated AN3-based protein complex, comprising at least the proteins AN3p and one or more of the proteins selected from the group encoded by AT4G16143, AT1G09270, AT3G06720, AT5G53480, AT3G60830, AT1G18450, AT2G46020, AT2G28290, AT1G21700, AT5G14170, AT4G17330, AT4G27550, AT1G65980, AT5G55210, AT3G15000, AT4G35550, AT1G20670, AT1G08730, AT5G13030, AT2G18876, AT5G17510, AT1G05370, AT4G21540, AT1G23900 and AT5G23690.
32. An isolated AN3-based protein complex comprises at least the proteins AN3p and one or more proteins selected from the group consisting of ARP4 (AT1G18450), ARP7 (AT3G60830), SNF2 (AT2G46020), SYD (AT2G28290), SWI3C (AT1G21700) and SWP73B (AT5G14170).
33. An isolated AN3-based protein complex according to item 2, whereby said protein complex comprises at least AN3p, an actin related protein selected from the group consisting of ARP4 and ARP7, an ATPase selected from the group consisting of SNF2 (BRM) and SYD and a SWIRM domain containing protein.
34. An isolated AN3-based protein complex according to item 3, whereby said SWIRM domain containing protein is SWI3C
35. The use of a protein complex according to any of the preceding items to promote plant growth.
36. A method to promote AN3-based protein complex formation by simultaneous overexpression of at least two proteins of the complex.

DESCRIPTION OF FIGURES

The present invention will now be described with reference to the following figures in which.

The total protein extract of 2-day-old wild-type and N- and C-terminal GS-tagged GFP and AN3 overexpressing cultures (60 µg) was separated by 12% SDS-PAGE and immunoblotted. For detection of GS-tagged proteins, blots were incubated with human blood plasma followed by incubation with anti-human IgG coupled to horseradish peroxidase. Protein gel blots were developed by Chemiluminiscent detection. The expected recombinant molecular masses for GS-tagged GFP and AN3 are 52.8 kDa and 43.5 kDa, respectively (indicated with a black dot).

Figure 2:
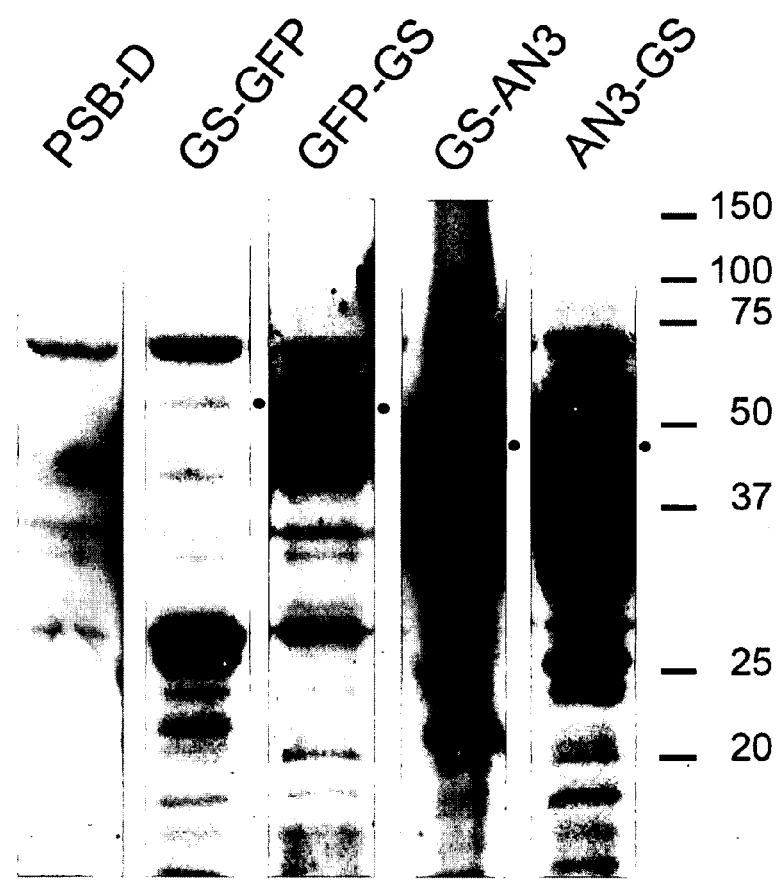

FIG. 2. Analysis of the TAP protein eluates.

GS-tagged protein complexes were purified from transgenic plant cell suspension cultures, precipitated with TCA (25%, v/v), separated on 4-12% NuPAGE gels, and visualized with colloidal Coomassie G-250 staining. Bait proteins are indicated with a dot.

Figure 3:
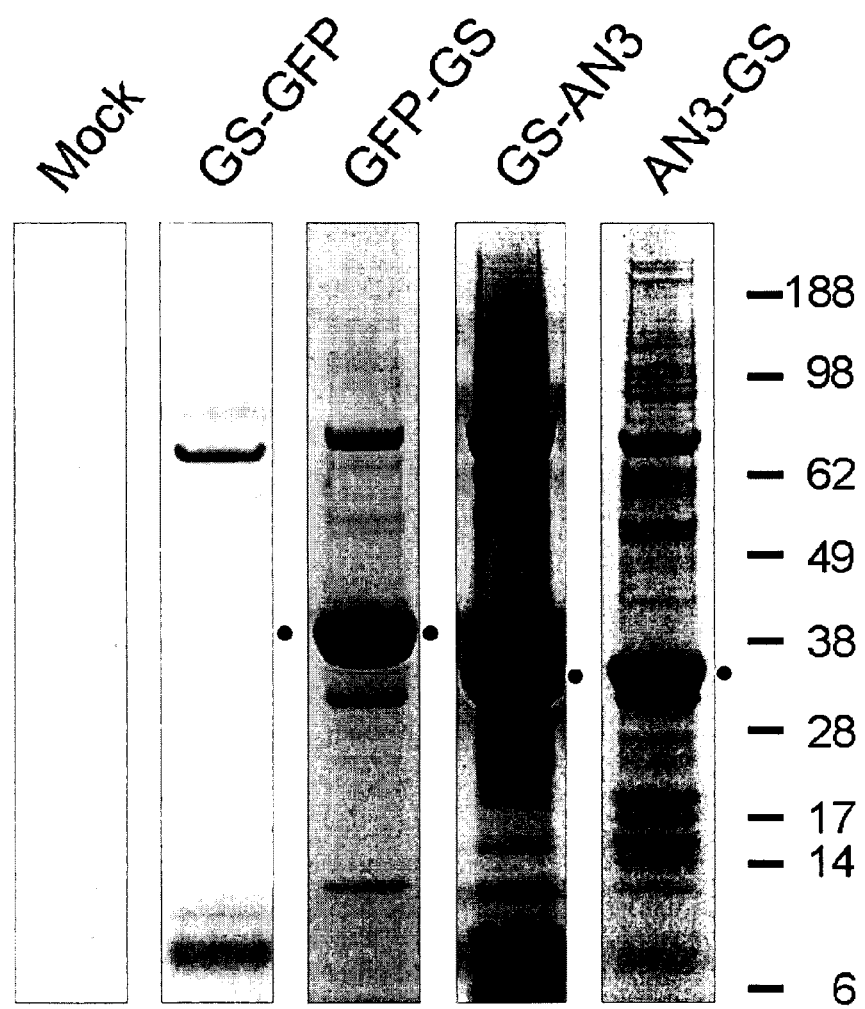

FIG. 3. represents the binary vector used for introducing and expressing in *Oryza sativa* of a iSYT-Like-encoding nucleic acid under the control of a plant promoter.

EXAMPLES

The present invention will now be described with reference to the following examples, which are by way of illustration alone. The following examples are not intended to completely define or otherwise limit the scope of the invention.

DNA manipulation: unless otherwise stated, recombinant DNA techniques are performed according to standard protocols described in (Sambrook (2001) Molecular Cloning: a laboratory manual, 3rd Edition Cold Spring Harbor Laboratory Press, CSH, New York) or in Volumes 1 and 2 of Ausubel et al. (1994), Current Protocols in Molecular Biology, Current Protocols. Standard materials and methods for plant molecular work are described in Plant Molecular Biology Labfax (1993) by R. D. D. Croy, published by BIOS Scientific Publications Ltd (UK) and Blackwell Scientific Publications (UK).

Example 1

Vector Construction: TAP Vectors

Construction of N- and C-terminal GS-tagged GFP and AN3 under the control of the 35S (CaMV) promoter was obtained by Multisite Gateway LR reactions. The coding regions, without (−) and with (+) stopcodon, were amplified by polymerase chain reaction (PCR) and cloned into the Gateway pDONR221 vector (Invitrogen) resulting in pEntryL1L2-GFP(−), pEntryL1L2-GFP(+), pEntryL1L2-AN3(−) and pEntryL1L2-AN3(+). The $Pro_{35S}$:GFP-GS- and $Pro_{35S}$:AN3-GS-containing plant transformation vectors were obtained by Multisite Gateway LR reaction between pEntryL4R1—$Pro_{35S}$, pEntryL1L2-GFP(−) or pEntryL1L2-AN3(−), and pEntryR2L3-GS and the destination vector pKCTAP, respectively (Van Leene et al., 2007). To obtain the Pro35S:GS-GFP and Pro35S:GS-AN3 vectors Multisite LR recombination between pEntryL4L3-$Pro_{35S}$ and pEntryL1 L2-GFP(+) or pEntryL1L2-AN3(+) with pKNGSTAP occurred.

All entry and destination vectors were checked by sequence analysis. Expression vectors were transformed to *Agrobacterium tumefaciens* strain C58C1Rif$^R$ (pMP90) by electroporation. Transformed bacteria were selected on yeast extract broth plates containing 100 µg/mL rifampicin, 40 µg/mL gentamicin, and 100 µg/mL spectinomycin.

Example 2

Cell Suspension Cultivation

Wild-type and transgenic *Arabidopsis thaliana* cell suspension PSB-D cultures were maintained in 50 mL MSMO medium (4.43 g/L MSMO, Sigma-Aldrich), 30 g/L sucrose, 0.5 mg/L NAA, 0.05 mg/L kinetin, pH 5.7 adjusted with 1M KOH) at 25° C. in the dark, by gentle agitation (130 rpm). Every 7 days the cells were subcultured in fresh medium at a 1/10 dilution.

Example 3

Cell Culture Transformation

The *Arabidopsis* culture was transformed by *Agrobacterium* co-cultivation as described previously (Van Leene et al., 2007). The *Agrobacterium* culture exponentially growing in YEB ($OD_{600}$ between 1.0 and 1.5) was washed three times by centrifugation (10 min at 5000 rpm) with an equal volume MSMO medium and resuspended in cell suspension growing medium until an $OD_{600}$ of 1.0. Two days after subcultivation, 3 mL suspension culture was incubated with 200 μL washed *Agrobacteria* and 200 μM acetoseringone, for 48 h in the dark at 25° C. with gentle agitation (130 rpm). Two days after co-cultivation, 7 mL MSMO containing a mix of three antibiotics (25 μg/mL kanamycin, 500 μg/mL carbenicellin, and 500 μg/mL vancomycin) was added to the cell cultures and grown further in suspension under standard conditions (25° C., 130 rpm and continuous darkness). The stable transgenic cultures were selected by sequenctional dilution in a 1:5 and 1:10 ratio in 50 mL fresh MSMO medium containing the antibiotics mix, respectively at 11, and 18 days post co-cultivation. After counter selecting the bacteria, the transgenic plant cells were further subcultured weekly in a 1:5 ratio in 50 mL MSMO medium containing 25 μg/mL kanamycin for two more weeks. Thereafter the cells were weekly subcultured in fresh medium at a 1/10 dilution.

Example 4

Expression Analysis of Cell Suspension Cultures

Transgene expression was analyzed in a total protein extract derived from exponentially growing cells, harvested two days after subculturing. Equal amounts of total protein were separated on 12% SDS-PAGE gels and blotted onto Immobilon-P membranes (Millipore, Bedford, Mass.). Protein gel blots were blocked in 3% skim milk in 20 mM Tris-HCl, pH 7.4, 150 mM NaCl, and 0.1% Triton X-100. For detection of GS-tagged proteins, blots were incubated with human blood plasma followed by incubation with anti-human IgG coupled to horseradish peroxidase (HRP; GE-Healthcare). Protein gel blots were developed by Chemiluminiscent detection (Perkin Elmer, Norwalk, Conn.).

Example 5

Protein Extract Preparation

Cell material (15 g) was grinded to homogeneity in liquid nitrogen. Crude protein extract were prepared in an equal volume (w/v) of extraction buffer (25 mM Tris-HCl, pH 7.6, 15 mM $MgCl_2$, 5 mM EGTA, 150 mM NaCl, 15 mM p-nitrophenylphosphate, 60 mM β-glycerophosphate, 0.1% (v/v) Nonidet P-40 (NP-40), 0.1 mM sodium vanadate, 1 mM NaF, 1 mM DTT, 1 mM PMSF, 10 μg/mL leupeptin, 10 μg/mL aprotinin, 5 μg/mL antipain, 5 μg/mL chymostatin, 5 μg/mL pepstatin, 10 μg/mL soybean trypsin inhibitor, 0.1 mM benzamidine, 1 μM trans-epoxysuccinyl-L-leucylamido-(4-guanidino)butane (E64), 5% (v/v) ethylene glycol) using an Ultra-Turrax T25 mixer (IKA Works, Wilmington, N.C.) at 4° C. The soluble protein fraction was obtained by a two-step centrifugation at 36900 g for 20 min and at 178000 g for 45 min, at 4° C. The extract was passed through a 0.45 μm filter (Alltech, Deerfield, Ill.) and the protein content was determined with the Protein Assay kit (Bio-Rad, Hercules, Calif.).

Example 6

Tandem Affinity Purification

Purifications were performed as described by Bürckstümmer et al. (2006), with some modifications. Briefly, 200 mg total protein extract was incubated for 1 h at 4° C. under gentle rotation with 100 μL IgG Sepharose 6 Fast Flow Flow beads (GE-Healthcare, Little Chalfont, UK), pre-equilibrated with 3 mL extraction buffer. The IgG Sepharose beads were transferred to a 1 mL Mobicol column (MoBiTec, Goettingen, Germany) and washed with 10 mL IgG wash buffer (10 mM Tris-HCl, pH 8.0, 150 mM NaCl, 0.1% NP-40, 5% ethylene glycol) and 5 mL Tobacco (*Nicotiana tabacum* L.) Etch Virus (TEV) buffer (10 mM Tris-HCl, pH 8.0, 150 mM NaCl, 0.1% (v/v) NP-40, 0.5 mM EDTA, 1 mM PMSF, 1 μM E64, 5% (v/v) ethylene glycol). Bound complexes were eluted via AcTEV digest (2×1000, Invitrogen) for 1 h at 16° C. The IgG eluted fraction was incubated for 1 h at 4° C. under gentle rotation with 100 μL Streptavidin resin (Stratagene, La Jolla, Calif.), pre-equilibrated with 3 mL TEV buffer. The Streptavidin beads were packed in a Mobicol column, and washed with 10 mL TEV buffer. Bound complexes were eluted with 1 mL streptavidin elution buffer (10 mM Tris-HCl, pH 8.0, 150 mM NaCl, 0.1% (v/v) NP-40, 0.5 mM EDTA, 1 mM PMSF, 1 μM E64, 5% (v/v) ethylene glycol, 20 mM Desthiobiotin), and precipitated using TCA (25% v/v). The protein pellet was washed twice with ice-cold aceton containing 50 mM HCl, redissolved in sample buffer and separated on 4-12% gradient NuPAGE gels (Invitrogen). Proteins were visualized with colloidal Coomassie brilliant blue staining.

Example 7

Proteolysis and Peptide Isolation

After destaining, gel slabs were washed for 1 hour in $H_2O$, polypeptide disulfide bridges were reduced for 40 min in 25 mL of 6.66 mM DTT in 50 mM $NH_4HCO_3$ and sequentially the thiol groups were alkylated for 30 min in 25 mL 55 mM IAM in 50 mM $NH_4HCO_3$. After washing the gel slabs 3 times with water, complete lanes from the protein gels were cut into slices, collected in microtiter plates and treated essentially as described before with minor modifications (Van Leene et al., 2007). Per microtiterplate well, dehydrated gel particles were rehydrated in 20 μL digest buffer containing 250 ng trypsin (MS Gold; Promega, Madison, Wis.), 50 mM $NH_4HCO_3$ and 10% $CH_3CN$ (v/v) for 30 min at 4° C. After adding 10 μL of a buffer containing 50 mM $NH_4HCO_3$ and 10% $CH_3CN$ (v/v), proteins were digested at 37° C. for 3 hours. The resulting peptides were concentrated and desalted with microcolumn solid phase tips (PerfectPure™ C18 tip, 200 mL bed volume; Eppendorf, Hamburg, Germany) and eluted directly onto a MALDI target plate (Opti-TOF™384 Well Insert; Applied Biosystems, Foster City, Calif.) using 1.2 μL of 50% $CH_3CN$: 0.1% $CF_3COOH$ solution saturated with α-cyano-4-hydroxycinnamic acid and spiked with 20 fmole/μL Glu1-Fibrinopeptide B (Sigma-Aldrich), 20 fmole/μL des-Pro2-Bradykinin (Sigma-Aldrich), and 20 fmole/μL Adrenocorticotropic Hormone Fragment 18-39 human (Sigma-Aldrich).

Example 8

Acquisition of Mass Spectra

A MALDI-tandem MS instrument (4800 Proteomics Analyzer; Applied Biosystems) was used to acquire peptide mass fingerprints and subsequent 1 kV CID fragmentation spectra of selected peptides. Peptide mass spectra and peptide sequence spectra were obtained using the settings essentially as presented in Van Leene et al. (2007). Each MALDI plate was calibrated according to the manufacturers' specifications. All peptide mass fingerprinting (PMF) spectra were internally calibrated with three internal standards at m/z 963.516 (des-Pro2-Bradykinin), m/z 1570.677 (Glu1-Fibrinopeptide B), and m/z 2465, 198 (Adrenocorticotropic Hormone Fragment 18-39) resulting in an average mass accuracy of 5 ppm±10 ppm for each analyzed peptide spot on the analyzed MALDI targets. Using the individual PMF spectra, up to sixteen peptides, exceeding a signal-to-noise ratio of 20 that passed through a mass exclusion filter were submitted to fragmentation analysis.

Example 9

MS-Based Protein Homology Identification

PMF spectra and the peptide sequence spectra of each sample were processed using the accompanied software suite (GPS Explorer 3.6, Applied Biosystems) with parameter settings essentially as described in Van Leene et al. (2007). Data search files were generated and submitted for protein homology identification by using a local database search engine (Mascot 2.1, Matrix Science). An in-house nonredundant Arabidopsis protein database called SNAPS Arabidopsis thaliana version 0.4 (SNAPS=Simple Nonredundant Assembly of Protein Sequences, 77488 sequence entries, 30468560 residues; available at ptools.ua.ac.be/snaps) was compiled from nine public databases. Protein homology identifications of the top hit (first rank) with a relative score exceeding 95% probability were retained. Additional positive identifications (second rank and more) were retained when the score exceeded the 98% probability threshold.

Example 10

Expression Analysis of GS-Tagged GFP and AN3 Overexpressing Cell Lines

Figure 1:
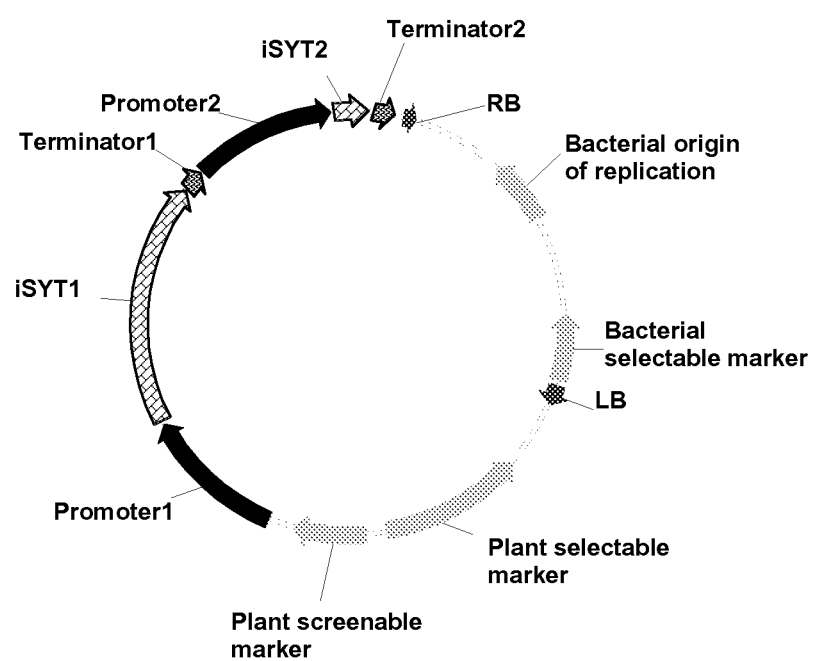
FIG. 1. Expression analysis of GS-tagged GFP and AN3 in transgenic cell suspension cultures.

Before performing TAP purifications stably transformed cell suspension cultures were screened on the protein expression level of the transgenes. Protein gel blotting of equal amounts of total protein extract derived from wild-type (PSB-D) cultures and GS-GFP, GFP-GS, GS-AN3, and AN3-GS overexpressing cell lines showed clear expression of the GS-tagged proteins (FIG. 1).

Example 11

TAP Purification of Wild-Type and GS-Tagged GFP Overexpressing Cultures

Despite the two successive purification steps performed within TAP purifications, background proteins co-purified by non-specific binding are an issue. Contaminating proteins due to experimental background were determined by purifications on wild-type and transgenic cultures overexpressing N- and C-terminal GS-tagged nuclear localized green fluorescent protein (GFP). Non-specific co-purified proteins were precipitated, separated on gel, stained (FIG. 2), trypsin digested and identified unambiguously by MALDI-TOF/TOF. Most contaminants are high abundant proteins, such as chaperones, cytoskeleton proteins, ribosomal proteins, metabolic enzymes, or protein translation factors (Table 0). Identical or similar proteins were found as common contaminants in other plant protein-protein interaction studies (Rohila et al., 2006; Van Leene et al., 2007).

Example 12

Tap Isolation and MS Identification of AN3 Interacting Proteins

In order to identify the interaction partners of AN3 in vivo, we performed tandem affinity (TAP) purifications on N- and C-terminal GS-fusions of AN3 ectopically expressed under control of the constitutive 35SCaMV promoter in transgenic Arabidopsis suspension cultures. Two independent TAP purifications were performed on extracts from AN3-GS and GS-AN3 lines, harvested two days after sub-culturing into fresh medium. The affinity purified proteins were separated on a 4-12% NuPAGE gel and stained with Coomassie Brilliant Blue. The purification profiles from transgenic cultures overexpressing AN3 is shown in FIG. 2. Protein bands were cut, in-gel digested with trypsin and subjected to MALDI-TOF/TOF mass spectrometry for protein identification. After substracting background proteins, identified by the control purifications described in example 2 and in other analyses (GUS and cytosolic GFP, Van Leene et al., 2007), from the obtained hit list we identified 25 AN3 interacting proteins (Table A). These can be divided into two groups: 14 proteins were confirmed experimentally and 11 proteins were identified only in one out of four TAP experiments.

Example 13

Isolation and Subunit Identification of AN3 Interacting SWI/SNF Chromatin Remodeling Complexes in Plants Among the experimentally confirmed AN3 interactors six proteins act as subunits of macromolecular machines that remodel chromatin structure. A database survey (ChromDB, Gendler et al., 2008) illustrates that all of them belong to the SWI/SNF ATPase family. SWI/SNF chromatin remodeling ATPases are conserved in the animal and the plant kingdom and regulate transcriptional programs in response to endogenous and exogenous cues. This suggests that the transcriptional activity of AN3 is regulated through chromatin remodeling. In agreement, the human AN3 homolog SYT was also shown to interact with the SWI/SNF complex components BRM and Brg1 (Thaete et al., 1999; Perani et al., 2003; Ishida et al., 2004).

Although the functional role of several putative SWI/SNF complex components has been studied in Arabidopsis, so far no complete plant chromatin remodeling complex has been isolated and characterized. The co-purification with AN3 gives for the first time proof of the in vivo physical composition of plant SWI/SNF complexes which before was based solely on homology analyses and the interpretation of genetic and in vitro interactions.

A literature survey illustrates that SWI/SNF ATPase subunits control multiple developmental pathways in Arabidopsis. Null mutants of the two isolated ATPases SYD (At2g28290) and BRM (SNF2) (At2g46020) display pleiotropic developmental defects. Both mutants are slow growing and dwarfed, have defects in cotyledon separation, and exhibit reduced apical dominance (Wagner & Meyerowitz, 2002; Farrona et al., 2004; Hurtado et al., 2006; Kwon et al., 2006; Su et al., 2006). Null mutants in BRM (SNF2) also have unique root growth defects and are male sterile (Wagner & Meyerowitz, 2002; Hurtado et al., 2006; Kwon et al., 2006). Core complex Swi3c (At1g21700) mutants closely resemble brm mutants (Sarnowski et al., 2005). Mutants of the accessory components ARP4 and ARP7 display pleiotropic defects with less resemblance to the syd, brm and swi3c phenotypes (Meagher et al., 2005). Down-regulation of ARP4 resulted in phenotypes including altered organization of plant organs, early flowering, delayed flower senescence and partial sterility (Kandasamy et al., 2005a). ARP7 knockdown results in dwarfed plants with small rosette leaves, highly retarded root growth, altered flower development and reduced fertility (Kandasamy et al., 2005b). Finally, RNAi-mediated silencing of the accessory SWI/SNF complex component SWP73B (At5g14170) resulted in dwarfed plants with shorter roots (Crane & Gelvin, 2007).

Example 14

Isolation and Identification of AN3 Interactors

With the exception of the SWI/SNF chromatin remodeling complex subunits all other 19 identified AN3 interactors are not or poorly characterized. Table B gives an overview of their GO biological process and molecular function.

Among them four interactors (At4g16143, At1g09270, At3g06720 and At5g53480) are involved in nucleocytoplasmic trafficking which identifies AN3 as one of the targets of plant nuclear transporters. Indeed a precise cellular localization is essential for protein function and nuclear localization is a key to the function of transcription factors. In plants, nucleocytoplasmic trafficking plays a critical role in various biological processes (Meier, 2007; Xu & Meier, 2008) and nuclear transporters have been shown to be involved in regulating different signal transduction pathways during plant development (Bollman et al., 2003) and in plant responses to biotic (Palma et al., 2005) and abiotic stresses (Verslues et al., 2006).

Another AN3 interactor, that is yet not characterized, is the trehalose phosphatase/synthase 4 (TPS4). Several studies in plants imply an important role of trehalose biosynthesis for plant growth, development and stress tolerance (Grennan, 2007). In the case of *Arabidopsis* TPS1, knockout mutants display an embryo lethal phenotype, suggesting a role of this gene in plant development (Eastmond et al., 2002). In addition, overexpression of TPS1 shed light on its role as a regulator of glucose, abscisic acid, and stress signalling (Avonce et al., 2004). The latter study, together with a recent analysis of a rice TPS triggering abiotic stress response gene induction when overexpressed (Ge et al., 2008), suggests a possible role for TPS genes in regulating transcriptional signaling pathways.

The other identified interactors indicate links of AN3 function in multiple processes. Several studies demonstrate the involvement of sphingosine kinases in plant cell signaling (Coursol et al., 2003; Coursol et al., 2005; Worral et al., 2008), whereas reports on myosin homologues (Peremyslov et al., 2008; Jiang et al., 2007) implicate roles of protein and organelle trafficking in plant development. The connections between these genes, the other identified interactors and AN3 will be interesting to study in the future.

TABLE 0

List of co-purifying proteins during TAP experiments of untransformed cell cultures, and of cultures ectopically expressing nuclear localized GFP

| Accession number | Protein name | Mock | GFP |
| --- | --- | --- | --- |
| At1g06780 | glycosyl transferase family 8 protein | | + |
| At1g07930 | elongation factor 1-alpha | | + |
| At1g09080 | luminal binding protein 3 (BiP-3) (BP3) | + | |
| At1g13440 | glyceraldehyde 3-phosphate dehydrogenase, cytosolic, | + | |
| At1g31230 | bifunctional aspartate kinase/homoserine dehydrogenase | + | |
| At1g34610 | Ulp1 protease family protein | | + |
| At1g50010 | tubulin alpha chain | | + |
| At1g61210 | WD-40 repeat family protein/katanin p80 subunit, putative | | + |
| At1g75010 | MORN repeat-containing protein | | + |
| At1g79920 | heat shock protein 70, putative | | + |
| At1g79930 | heat shock protein, putative | | + |
| At2g07620 | putative helicase | | + |
| At2g21410 | vacuolar proton ATPase, putative | + | |
| At2g26570 | expressed protein | + | |
| At3g07160 | glycosyl transferase family 48 protein | + | |
| At3g09170 | Ulp1 protease family protein | | + |
| At3g09440 | heat shock cognate 70 kDa protein 3 | | + |
| At3g11950 | ATHST; prenyltransferase | | + |
| At3g12580 | heat shock protein 70, putative | | + |
| At3g17390 | S-adenosylmethionine synthetase, putative | + | |
| At3g18530 | expressed protein | | + |
| At3g26020 | serine/threonine protein phosphatase 2A regulatory subunit B' | + | |
| At3g42100 | AT hook motif-containing protein-related | | + |
| At3g48870 | ATP-dependent Clp protease ATP-binding subunit (ClpC) | + | |
| At3g49640 | nitrogen regulation family protein | + | |
| At3g54940 | cysteine proteinase, putative | | + |
| At4g00020 | BRCA2A (breast cancer 2 like 2A) | | + |
| At4g09800 | 40S ribosomal protein S18 | | + |
| At4g14960 | tubulin alpha chain | + | |
| At4g18080 | hypothetical protein | | + |
| At4g20160 | expressed protein | | + |
| At4g20890 | tubulin beta chain | | + |
| At4g31820 | phototropic-responsive NPH3 family protein | | + |
| At4g33200 | myosin, putative | | + |
| At5g02490 | heat shock cognate 70 kDa protein 2 | | + |
| At5g02500 | heat shock cognate 70 kDa protein 1 | | + |
| At5g08670 | ATP synthase beta chain, mitochondrial | | + |
| At5g08680 | ATP synthase beta chain, mitochondrial | | + |
| At5g08690 | ATP synthase beta chain, mitochondrial | | + |
| At5g09810 | actin 7 (ACT7)/actin 2 | + | + |
| At5g18110 | Novel cap-binding protein (nCBP) | | + |
| At5g28540 | luminal binding protein 1 (BiP-1) (BP1) | + | + |

TABLE 0-continued

List of co-purifying proteins during TAP experiments of untransformed cell cultures, and of cultures ectopically expressing nuclear localized GFP

| Accession number | Protein name | Mock | GFP |
|---|---|---|---|
| At5g35360 | acetyl-CoA carboxylase, biotin carboxylase subunit (CAC2) | + | |
| At5g40060 | disease resistance protein (TIR-NBS-LRR class), putative | | + |
| At5g42020 | luminal binding protein 2 (BiP-2) (BP2) | | + |
| At5g44340 | tubulin beta chain | | + |
| At5g60390 | elongation factor 1-alpha | | + |
| At5g62700 | tubulin beta chain | | + |

TABLE A

AN3 and List of AN3-copurified proteins identified by MS.

| AGI code | Description | MW (kDa) | Peptide count | Protein score/threshold | Best ion score/threshold | |
|---|---|---|---|---|---|---|
| AT5G28640 | AN3, SYT1, SYT, GIF1 | | | | | |
| AT4G16143 | importin alpha-2, putative (IMPA2) | 49.5 | 13 | 388/61 | 84/28 | 2 |
| AT1G09270 | importin alpha-1 subunit, putative (IMPA4) | 59.4 | 6 | 74/61 | 37/31 | 1 |
| AT3G06720 | importin alpha-1 subunit, putative (IMPA1) | 58.6 | 8 | 160/61 | 62/28 | 2 |
| AT5G53480 | importin beta-2, putative | 96.2 | 16 | 295/61 | 50/32 | 2 |
| AT3G60830 | actin-related protein 7 (ARP7) | 39.9 | 12 | 285/61 | 53/28 | 3 |
| AT1G18450 | actin-related protein 4 (ARP4) | 48.9 | 12 | 230/61 | 44/28 | 2 |
| AT2G46020 | transcription regulatory protein SNF2 (ATPase) | 245.4 | 31 | 351/61 | 57/31 | 2 |
| AT2G28290 | chromatin remodeling protein, SYD ATPase | 389.8 | 22 | 118/61 | 53/31 | 4 |
| AT1G21700 | SWIRM domain-containing protein/DNA-binding family protein | 88.2 | 5 | | 32/32 | 2 |
| AT5G14170 | SWIB complex BAF60b domain-containing protein | 59.2 | 18 | 302/61 | 43/31 | 2 |
| AT4G17330 | G2484-1, agenet (tudor-like) domain-containing protein | 113.3 | 25 | 317/61 | 61/32 | 3 |
| AT4G27550 | trehalose phosphatase/synthase 4 | 89.4 | 15 | 68/61 | | 2 |
| AT1G65980 | thioredoxin-dependent peroxidase | 17.4 | 8 | 80/61 | | 2 |
| AT5G55210 | expressed protein | 18.5 | 4 | 105/61 | 49/31 | 2 |
| AT3G15000 | expressed protein similar to DAG protein | 42.8 | 3 | | 38/30 | 2 |
| AT4G35550 | homeobox-leucine zipper protein (HB-2)/HD-ZIP protein | 29.6 | 3 | | 33/28 | 1 |
| AT1G20670 | DNA-binding bromodomain-containing protein | 72.9 | 16 | 75/61 | | 1 |
| AT1G08730 | myosin heavy chain (PCR43) (Fragment) | 174.6 | 18 | 70/61 | | 1 |
| AT5G13030 | expressed protein | 71.1 | 3 | | 31/29 | 1 |
| AT2G18876 | expressed protein | 43.5 | 11 | 67/61 | | 1 |
| AT5G17510 | expressed protein | 42.5 | 3 | | 37/28 | 1 |
| AT1G05370 | expressed protein | 49.9 | 12 | 66/61 | | 1 |
| AT4G21540 | putative sphingosine kinase (SphK) | 141.7 | 9 | 69/61 | | 1 |
| AT1G23900 | gamma-adaptin | 96.4 | 19 | 78/61 | | 1 |
| AT5G23690 | polynucleotide adenylyltransferase family protein | 59.6 | 11 | 66/61 | | 1 |

The last column tells in how many of the four independent experiments an interactor was identified.

TABLE B

| AGI Code | Name/Description | GO Biological Process | GO Molecular Function |
|---|---|---|---|
| At4g16143 | Importin alpha-2 (IMP2) | Protein import into nucleus | Protein transporter activity |
| At1g09270 | Importin alpha-1 (IMPA4) | Intracellular protein transport | Protein transporter activity |
| At3g06720 | Importin alpha-1 (IMPA1) | Intracellular protein transport | Protein transporter activity |
| At5g53480 | Importin beta-2 | Protein import into nucleus | Protein transporter activity |
| At4g17330 | G2484-1 protein | unknown | RNA binding |

TABLE B-continued

| AGI Code | Name/Description | GO Biological Process | GO Molecular Function |
|---|---|---|---|
| At4g27550 | Trehalose phosphatase/synthase 4 (TPS4) | Trehalose biosynthesis | Trehalose phosphate synthase activity |
| At1g65980 | Thioredoxin-dependent peroxidase 1 (TPX1) | unknown | Antioxidant activity |
| At5g55210 | Expressed protein | unknown | unknown |
| At3g15000 | Expressed protein similar to DAG protein | unknown | unknown |
| At4g35550 | Wuschel-related homeobox 13 (WOX13) | Regulation of transcription | DNA binding |
| At1g20670 | Bromodomain-containing protein | unknown | DNA binding |
| At1g08730 | Myosin-like protein XIC | Actin filament-based movement | Protein binding |
| At5g13030 | Expressed protein | unknown | unknown |
| At2g18876 | Expressed protein | unknown | unknown |
| At5g17510 | Expressed protein | unknown | unknown |
| At1g05370 | Expressed protein | unknown | unknown |
| At4g21540 | Putative sphingosine kinase | Activation of protein kinase C activity | Kinase activity |
| At1g23900 | Gamma-adaptin | Vesicle-mediated transport | Clathrin binding |
| At5g23690 | Polynucleotide adenylyltransferase protein | RNA processing | RNA binding |

Example 15

Identification of Sequences Related to iSYT

Sequences (full length cDNA, ESTs or genomic) related to iSYT nucleic acid and polypeptides were identified amongst those maintained in the Entrez Nucleotides database at the National Center for Biotechnology Information (NCBI) and other sequence databases using database sequence search tools, such as the Basic Local Alignment Tool (BLAST) (Altschul et al. (1990) J. Mol. Biol. 215:403-410; and Altschul et al. (1997) Nucleic Acids Res. 25:3389-3402). The program is used to find regions of local similarity between sequences by comparing nucleic acid or polypeptide sequences to sequence databases and by calculating the statistical significance of matches. For example, the polypeptide encoded by the nucleic acid of SYT was used for the TBLASTN algorithm, with default settings and the filter to ignore low complexity sequences set off. The output of the analysis was viewed by pairwise comparison, and ranked according to the probability score (E-value), where the score reflect the probability that a particular alignment occurs by chance (the lower the E-value, the more significant the hit). In addition to E-values, comparisons were also scored by percentage identity. Percentage identity refers to the number of identical nucleotides (or amino acids) between the two compared nucleic acid (or polypeptide) sequences over a particular length. In some instances, the default parameters may be adjusted to modify the stringency of the search. For example the E-value may be increased to show less stringent matches. This way, short nearly exact matches may be identified.

Tables A2 to A26 provides a list of polypeptide sequences related to the polypeptides of Table A.

Sequences have been tentatively assembled and publicly disclosed by research institutions, such as The Institute for Genomic Research (TIGR; beginning with TA). The Eukaryotic Gene Orthologs (EGO) database may be used to identify such related sequences, either by keyword search or by using the BLAST algorithm with the nucleic acid sequence or polypeptide sequence of interest. Special nucleic acid sequence databases have been created for particular organisms, such as by the Joint Genome Institute. Furthermore, access to proprietary databases, has allowed the identification of novel nucleic acid and polypeptide sequences.

Concerning SYT

TABLE A2

Preferred homologous polypeptides of SYT

| Name | Source organism | Database accession number |
|---|---|---|
| Arath_SYT2 | Arabidopsis thaliana | AY102640.1 |
| Arath_SYT3 | Arabidopsis thaliana | AY102641.1 |
| Allce_SYT2 | Allium cepa | CF437485 |
| Aqufo_SYT1 | Aquilegia formosa × Aquilegia pubescens | DT758802.1 |
| Aqufo_SYT2 | Aquilegia formosa × Aquilegia pubescens | TA15831_338618 T25K16.15 |
| Aspof_SYT1 | Aspergillus officinalis | CV287542 |
| Betvu_SYT2 | Beta vulgaris | BQ594749.1 BQ594658.1 |
| Bradi_SYT3 | Brachypodium distachyon | DV480064.1 |
| Brana_SYT1 | Brassica napus | CD823592 |
| Brana_SYT2 | Brassica napa | CN732814 |
| Chlre_SYT | Chlamydomonas reinhardtii | BQ814858, jgi_Chlre3_194013_estExt_fgenesh2_pg.C_510025 |
| Citsi_SYT1 | Citrus sinensis | CB290588 |
| Citsi_SYT2 | Citrus sinensis | CV717501 |
| Cryja_SYT1 | Cryptomeria japonica | TA3001_3369_2 |
| Curlo_SYT2 | Curcuma longa | TA2676_136217 |
| Eupes_SYT2 | Euphorbia esula | DV144834 |
| Frave_SYT2 | Fragaria vesca | DY668312 |
| Glyma_SYT1.1 | Glycine max | TA55102_3847 |
| Glyma_SYT1.2 | Glycine max | TA51451_3847 |
| Glyma_SYT2.1 | Glycine max | BQ612648 |
| Glyma_SYT2.2 | Glycine max | TA48452_3847 |
| Glyso_SYT2 | Glycine soya | CA799921 |
| Gosar_SYT1 | Gossypium arboreum | BM359324 |
| Goshi_SYT1 | Gossypium hirsutum | DT558852 |
| Goshi_SYT2 | Gossypium hirsutum | DT563805 |
| Helan_SYT1 | Helianthus annuus | TA12738_4232 |

TABLE A2-continued

Preferred homologous polypeptides of SYT

| Name | Source organism | Database accession number |
|---|---|---|
| Horvu_SYT2 | Hordeum vulgare | CA032350 |
| Lacse_SYT2 | Lactuca serriola | DW110765 |
| Lyces_SYT1 | Lycopersicon esculentum | AW934450.1 BP893155.1 |
| Maldo_SYT2 | Malus domestica | CV084230 DR997566 |
| Medtr_SYT1 | Medicago trunculata | CA858507.1 |
| Medtr_SYT2 | Medicago trunculata | CA858743 BI310799.1 AL382135.1 |
| Orysa_SYT1 | Oryza sativa | AK058575 |
| Orysa_SYT2 | Oryza sativa | AK105366 |
| Orysa_SYT3 | Oryza sativa | BP185008 |
| Panvi_SYT3 | Panicum virgatum | DN152517 |
| Phypa_SYT1.1 | Physcomitrella patens | TA28566_3218 |
| Phypa_SYT1.2 | Physcomitrella patens | TA21282_3218 |
| Phypa_SYT1.3 | Physcomitrella patens | TA20922_3218 |
| Phypa_SYT1.4 | Physcomitrella patens | TA29452_3218 |
| Picsi_SYT1 | Picea sitchensis | DR484100 DR478464.1 |
| Pinta_SYT1 | Pinus taeda | DT625916 |
| Poptr_SYT1 | Populus trichocarpa | DT476906 |
| Poptr_SYT2 | Populus trichocarpa | scaff_XIV.493 |
| Poptr_SYT1.2 | Populus trichocarpa | CV257942.1 |
| Prupe_SYT2 | Prunus persica | DT454880.1 DT455286.1 |
| Sacof_SYT1 | Saccharum officinarum | CA078249.1 CA078630 CA082679 CA234526 CA239244 CA083312 |
| Sacof_SYT2 | Saccharum officinarum | CA110367 |
| Sacof_SYT3 | Saccharum officinarum | CA161933.1 CA265085 |
| Soltu_SYT1.1 | Solanum tuberosum | CK265597 |
| Soltu_SYT1.2 | Solanum tuberosum | BG590990 |
| Soltu_SYT3 | Solanum tuberosum | CK272804 |
| Sorbi_SYT1 | Sorghum bicolor | TA40712_4558 |
| Sorbi_SYT2 | Sorghum bicolor | CF482417 CW376917 |
| Sorbi_SYT3 | Sorghum bicolor | CX611128 |
| Taxof_SYT2 | Taraxacum officinale | TA1299_50225 |
| Taxof_SYT3 | Taraxacum officinale | TA5000_50225 |
| Triae_SYT1 | Triticum aestivum | TA105893_4565 |
| Triae_SYT2 | Triticum aestivum | CD901951 |
| Triae_SYT3 | Triticum aestivum | BJ246754 BJ252709 |
| Vitvi_SYT1.1 | Vitis vinifera | DV219834 |
| Vitvi_SYT1.2 | Vitis vinifera | EE108079 |
| Vitvi_SYT2.1 | Vitis vinifera | EC939550 |
| Vitvi_SYT2.2 | Vitis vinifera | EE094148.1 EC964169.1 |
| Volca_SYT | Volvox carteri | JGI_CBHO11121.fwdJGI_CBHO11121.rev |
| Welmi_SYT | Welwitschia mirabilis | DT598761 |
| Zeama_SYT1 | Zea mays | BG874129.1 CA409022.1 |
| Zeama_SYT2 | Zea mays | AY106697 |
| Zeama_SYT3 | Zea mays | CO468901 |
| Homsa_SYT | Homo sapiens | CR542103 |

Concerning the AT1G05370 Polypeptide

TABLE A2

Preferred homologous polypeptides. of AT1G05370 polypeptide

| iSYT | Name homologue |
|---|---|
| AT1G05370.1 | G. max_Glyma20g28380.3#1 |
| AT1G05370.1 | M. truncatula_AC161569_9.5#1 |

TABLE A2-continued

Preferred homologous polypeptides. of AT1G05370 polypeptide

| iSYT | Name homologue |
|---|---|
| AT1G05370.1 | O. sativa_Os03g0219100#1 |
| AT1G05370.1 | P. patens_NP13131528#1 |
| AT1G05370.1 | P. trichocarpa_scaff_X.810#1 |
| AT1G05370.1 | Z. mays_ZM07MC22382_BFb0062G18@22320#1 |

Concerning AT1G08730 Polypeptide

TABLE A3

Preferred homologous polypeptides. of AT1G08730 polypeptide

| iSYT | Name homologue |
|---|---|
| AT1G08730.1 | >G. max_Glyma13g16710.1#1 |
| AT1G08730.1 | >M. truncatula_CU041231_65.4#1 |
| AT1G08730.1 | >O. sativa_Os06g0488200#1 |
| AT1G08730.1 | >P. patens_TC53472#1 |
| AT1G08730.1 | >P. trichocarpa_scaff_201.14#1 |
| AT1G08730.1 | >T. aestivum_TC339658#1 |
| AT1G08730.1 | >Z. mays_TC526723#1 |

Concerning AT1G09270 Polypeptide

TABLE A4

Preferred homologous polypeptides. of AT1G09270 polypeptide

| iSYT | Name homologue |
|---|---|
| AT1G09270.1 | >B. napus_TC77714#1 |
| AT1G09270.1 | >G. max_Glyma09g04430.1#1 |
| AT1G09270.1 | >G. hirsutum_ES800234#1 |
| AT1G09270.1 | >H. vulgare_TC178368#1 |
| AT1G09270.1 | >M. truncatula_AC191599_15.4#1 |
| AT1G09270.1 | >O. sativa_Os05g0155500#1 |
| AT1G09270.1 | >P. patens_TC29288#1 |
| AT1G09270.1 | >P. trichocarpa_scaff_XIII.64#1 |
| AT1G09270.1 | >S. lycopersicum_TC192018#1 |
| AT1G09270.1 | >T. aestivum_TC326489#1 |
| AT1G09270.1 | >Z. mays_ZM07MC09815_62040840@9797#1 |

Concerning AT1G18450 Polypeptide

TABLE A5

Preferred homologous polypeptides. of AT1G18450 polypeptide

| iSYT | Name homologue |
|---|---|
| AT1G18450.1 | >B. napus_BN06MC30721_51397463@30594#1 |
| AT1G18450.1 | >G. max_TC298093#1 |
| AT1G18450.1 | >G. hirsutum_TC140956#1 |
| AT1G18450.1 | >H. vulgare_c62682376hv270303@11037#1 |
| AT1G18450.1 | >M. truncatula_CU179920_30.3#1 |
| AT1G18450.1 | >O. sativa_Os08g0137200#1 |
| AT1G18450.1 | >P. patens_TC46936#1 |
| AT1G18450.1 | >P. trichocarpa_scaff_XII.526#1 |
| AT1G18450.1 | >S. lycopersicum_TC191897#1 |
| AT1G18450.1 | >T. aestivum_TC318743#1 |
| AT1G18450.1 | >Z. mays_ZM07MC12195_62264430@12170#1 |

Concerning AT1G20670 Polypeptide

TABLE A6

Preferred homologous polypeptides. of AT1G20670 polypeptide.

| iSYT | Name homologue |
|---|---|
| AT1G20670 | >G. max_Glyma04g01850.1#1 |
| AT1G20670 | >O. sativa_LOC_Os09g37760.1#1 |
| AT1G20670 | >P. patens_TC29124#1 |
| AT1G20670 | >P. trichocarpa_scaff_II.76#1 |

Concerning AT1G20670 Polypeptide

TABLE A7

Preferred homologous polypeptides. of AT1G20670 polypeptide.

| iSYT | Name homologue |
|---|---|
| AT1G21700 | >O. sativa_LOC_Os11g08080.1#1 |
| AT1G21700 | >P. trichocarpa_scaff_V.882#1 |

Concerning AT1G23900 Polypeptide

TABLE A8

Preferred homologous polypeptides. of AT1G23900 polypeptide.

| iSYT | Name homologue |
|---|---|
| AT1G23900 | >B. napus_TC72705#1 |
| AT1G23900 | >G. max_Glyma01g03890.1#1 |
| AT1G23900 | >M. truncatula_CT025838_33.5#1 |
| AT1G23900 | >O. sativa_LOC_Os06g07090.2#1 |
| AT1G23900 | >P. patens_TC30541#1 |
| AT1G23900 | >P. trichocarpa_831911#1 |

Concerning AT1G65980 Polypeptide

TABLE A10

Preferred homologous polypeptides. of AT1G65980 polypeptide.

| iSYT | Name homologue |
|---|---|
| AT1G65980 | >B. napus_TC67111#1 |
| AT1G65980 | >G. hirsutum_BE055703#1 |
| AT1G65980 | >G. max_TC283792#1 |
| AT1G65980 | >H. vulgare_TC156915#1 |
| AT1G65980 | >M. truncatula_TC127082#1 |
| AT1G65980 | >O. sativa_TC321488#1 |
| AT1G65980 | >P. patens_TC40270#1 |
| AT1G65980 | >P. trichocarpa_scaff_XIII.916#1 |
| AT1G65980 | >S. lycopersicum_TC196845#1 |
| AT1G65980 | >T. aestivum_TC288115#1 |
| AT1G65980 | >Z. mays_TC535995#1 |

Concerning AT2G18876 Polypeptide

TABLE A11

Preferred homologous polypeptides. of AT2G18876 polypeptide.

| iSYT | Name homologue |
|---|---|
| AT2G18876 | >B. napus_TC73647#1 |
| AT2G18876 | >G. max_Glyma17g07040.1#1 |
| AT2G18876 | >M. truncatula_TC118724#1 |
| AT2G18876 | >O. sativa_Os08g0242900#1 |
| AT2G18876 | >P. patens_186245#1 |
| AT2G18876 | >P. trichocarpa_825889#1 |
| AT2G18876 | >Z. mays_TC516387#1 |

Concerning AT2G28290 Polypeptide

TABLE A12

Preferred homologous polypeptides. of AT2G28290 polypeptide.

| iSYT | Name homologue |
|---|---|
| AT2G28290 | >B. napus_TC67556#1 |
| AT2G28290 | >G. hirsutum_TC164446#1 |
| AT2G28290 | >G. max_Glyma17g02540.2#1 |
| AT2G28290 | >M. truncatula_NP7265773#1 |
| AT2G28290 | >O. sativa_LOC_Os06g14406.1#1 |
| AT2G28290 | >P. trichocarpa_565765#1 |
| AT2G28290 | >Z. mays_TC537619#1 |

Concerning AT2G46020 Polypeptide

TABLE A13

Preferred homologous polypeptides. of AT2G46020 polypeptide.

| iSYT | Name homologue |
|---|---|
| AT2G46020 | >G. max_Glyma18g46930.1#1 |
| AT2G46020 | >M. truncatula_TC112587#1 |
| AT2G46020 | >P. trichocarpa_scaff_XIV.322#1 |

Concerning AT3G06720 Polypeptide

TABLE A14

Preferred homologous polypeptides..

| iSYT | Name homologue |
|---|---|
| AT3G06720 | >B. napus_TC67085#1 |
| AT3G06720 | >G. hirsutum_ES815460#1 |
| AT3G06720 | >G. max_Glyma17g03430.1#1 |
| AT3G06720 | >H. vulgare_TC178368#1 |
| AT3G06720 | >M. truncatula_AC191599_15.4#1 |
| AT3G06720 | >O. sativa_LOC_Os01g14950.1#1 |
| AT3G06720 | >P. patens_218909#1 |
| AT3G06720 | >P. trichocarpa_833349#1 |
| AT3G06720 | >S. lycopersicum_TC192018#1 |
| AT3G06720 | >T. aestivum_TC285294#1 |
| AT3G06720 | >Z. mays_TC468320#1 |

Concerning AT3G15000 Polypeptide

TABLE A15

Preferred homologous polypeptides..

| iSYT | Name homologue |
|---|---|
| AT3G15000 | >B. napus_TC99775#1 |
| AT3G15000 | >G. hirsutum_TC130654#1 |
| AT3G15000 | >G. max_Glyma13g34670.1#1 |
| AT3G15000 | >H. vulgare_TC171299#1 |
| AT3G15000 | >M. truncatula_TC121620#1 |
| AT3G15000 | >O. sativa_LOC_Os09g33480.1#1 |
| AT3G15000 | >P. trichocarpa_scaff_146.21#1 |
| AT3G15000 | >S. lycopersicum_TC212195#1 |
| AT3G15000 | >T. aestivum_TC287172#1 |
| AT3G15000 | >Z. mays_TC476358#1 |

Concerning AT3G60830 Polypeptide

TABLE A16

| iSYT | Name homologue |
|---|---|
| | Preferred homologous polypeptides.. |
| AT3G60830 | >B. napus_TC83795#1 |
| AT3G60830 | >G. hirsutum_ES802301#1 |
| AT3G60830 | >G. max_Glyma12g01010.1#1 |
| AT3G60830 | >M. truncatula_TC123694#1 |
| AT3G60830 | >O. sativa_TC300228#1 |
| AT3G60830 | >P. patens_TC39330#1 |
| AT3G60830 | >P. trichocarpa_TC89949#1 |
| AT3G60830 | >S. lycopersicum_TC194794#1 |
| AT3G60830 | >T. aestivum_TC308484#1 |
| AT3G60830 | >Z. mays_TC515322#1 |

Concerning AT3G60830 Polypeptide

TABLE A17

| iSYT | Name homologue |
|---|---|
| | Preferred homologous polypeptides. |
| AT4G16143 | >B. napus_TC67085#1 |
| AT4G16143 | >G. max_Glyma15g15480.1#1 |
| AT4G16143 | >G. hirsutum_ES815460#1 |
| AT4G16143 | >H. vulgare_TC178368#1 |
| AT4G16143 | >M. truncatula_AC191599_15.4#1 |
| AT4G16143 | >O. sativa_Os01g0253300#1 |
| AT4G16143 | >P. patens_TC52982#1 |
| AT4G16143 | >P. trichocarpa_833349#1 |
| AT4G16143 | >S. lycopersicum_TC192018#1 |
| AT4G16143 | >T. aestivum_TC285294#1 |
| AT4G16143 | >Z. mays_c62040840gm030403@6670#1 |

Concerning AT4G17330 Polypeptide

TABLE A18

| iSYT | Name homologue |
|---|---|
| | Preferred homologous polypeptides. |
| AT4G17330 | >B. napus_EE448802#1 |
| AT4G17330 | >G. max_TC316889#1 |
| AT4G17330 | >M. truncatula_TC114019#1 |
| AT4G17330 | >O. sativa_LOC_Os10g41030.3#1 |
| AT4G17330 | >P. trichocarpa_scaff_29.51#1 |

Concerning AT4G21540 Polypeptide

TABLE A19

| iSYT | Name homologue |
|---|---|
| | Preferred homologous polypeptides. |
| AT4G21540 | >G. max_Glyma07g30980.1#1 |
| AT4G21540 | >M. truncatula_AC175090_33.4#1 |
| AT4G21540 | >O. sativa_LOC_Os02g54490.1#1 |
| AT4G21540 | >P. patens_TC39605#1 |
| AT4G21540 | >P. trichocarpa_scaff_IV.215#1 |
| AT4G21540 | >Z. mays_TC484353#1 |

Concerning AT4G27550. Polypeptide

TABLE A20

| iSYT | Name homologue |
|---|---|
| | Preferred homologous polypeptides. |
| AT4G27550 | >B. napus_BN06MC19686_46389379@19622#1 |
| AT4G27550 | >G. max_Glyma12g36280.1#1 |
| AT4G27550 | >G. hirsutum_TC168377#1 |
| AT4G27550 | >M. truncatula_AC153460_26.4#1 |
| AT4G27550 | >O. sativa_LOC_Os05g44210.1#1 |
| AT4G27550 | >P. patens_TC45371#1 |
| AT4G27550 | >P. trichocarpa_scaff_168.14#1 |
| AT4G27550 | >S. lycopersicum_TC197800#1 |
| AT4G27550 | >T. aestivum_TC314116#1 |
| AT4G27550 | >Z. mays_ZM07MC29609_BFb0010E24@29519#1 |

Concerning AT4G35550 Polypeptide

TABLE A21

| iSYT | Name homologue |
|---|---|
| | Preferred homologous polypeptides. |
| AT4G35550 | >B. napus_BN06MC07552_42595637@7533#1 |
| AT4G35550 | >G. max_Glyma18g52490.1#1 |
| AT4G35550 | >G. hirsutum_TC148918#1 |
| AT4G35550 | >M. truncatula_TC115228#1 |
| AT4G35550 | >O. sativa_TC326307#1 |
| AT4G35550 | >P. patens_TC45997#1 |
| AT4G35550 | >P. trichocarpa_scaff_V.401#1 |
| AT4G35550 | >T. aestivum_CJ574771#1 |
| AT4G35550 | >Z. mays_TA9709_4577999#1 |

Concerning AT5G13030 Polypeptide

TABLE A21

| iSYT | Name homologue |
|---|---|
| | Preferred homologous polypeptides. |
| AT5G13030 | >B. napus_TC91422#1 |
| AT5G13030 | >G. max_Glyma20g39090.1#1 |
| AT5G13030 | >G. hirsutum_TC174829#1 |
| AT5G13030 | >M. truncatula_AC149471_14.5#1 |
| AT5G13030 | >O. sativa_TC288127#1 |
| AT5G13030 | >P. patens_TC30567#1 |
| AT5G13030 | >P. trichocarpa_scaff_I.133#1 |
| AT5G13030 | >T. aestivum_c54479201@7744#1 |
| AT5G13030 | >Z. mays_ZM07MC31636_BFb0358L02@31542#1 |

Concerning AT5G14170 Polypeptide

TABLE A22

| iSYT | Name homologue |
|---|---|
| | Preferred homologous polypeptides. |
| AT5G14170 | >AT5G14170.1 | Symbols: CHC1 | CHC1 | chr5: 4568696-4570444 REVERSE |
| AT5G14170 | >A. thaliana_AT3G01890.1#1 |
| AT5G14170 | >AC189564.2 Brassica rapa subsp. pekinensis clone KBrH009B23 |
| AT5G14170 | >XM_002273713 Vitis vinifera hypothetical protein LOC100261825 |
| AT5G14170 | >O. sativa_LOC_Os04g31320.1#1 |
| AT5G14170 | >Oryza sativa AL662977 |
| AT5G14170 | >P. patens_113811#1 |
| AT5G14170 | >P. trichocarpa_scaff_XII.899#1 |
| AT5G14170 | >P. trichocarpa_scaff_88.108#1 |
| AT5G14170 | >P. trichocarpa_scaff_I.2133#1 |
| AT5G14170 | >T. aestivum_c59835991@17741#1 |

TABLE A22-continued

Preferred homologous polypeptides.

| iSYT | Name homologue |
|---|---|
| AT5G14170 | >*Triticum aestivum* AK335297 |
| AT5G14170 | >*Z. mays*_ZM07MC18894_BFb0157J03@18844#1_FL467690.1| |

Concerning AT5G17510 Polypeptide

TABLE A23

Preferred homologous polypeptides.

| iSYT | Name homologue |
|---|---|
| AT5G17510 | >*A. thaliana* putative glutamine-rich protein (At5g17510) mRNA, complete cds gi_17979156_gb_AY070079.1_ |
| AT5G17510 | >*Vitis vinifera* hypothetical protein LOC100249418 (LOC100249418), mRNAgi_225454640_ref_XM_002267054.1_ |
| AT5G17510 | >*Ricinus communis* conserved hypothetical protein, mRNAgi_255566123_ref_XM_002524004.1_ |
| AT5G17510 | >*Solanum lycopersicum* cDNA, clone: LEFL1007BC07, HTC in leafgi_225312930_dbj_AK320272.1_ |
| AT5G17510 | >*Sorghum bicolor* hypothetical protein, mRNAgi_242085467_ref_XM_002443114.1_ |
| AT5G17510 | >*Triticum aestivum* cDNA, clone: WT002_P07, cultivar: Chinese Spring gi_241984762_dbj_AK332022.1_ |
| AT5G17510 | >*Zea mays* hypothetical protein LOC100276166 (LOC100276166), mRNAgi_226508721_ref_NM_001150017.1_ |

Concerning AT5G23690 Polypeptide

TABLE A24

Preferred homologous polypeptides.

| iSYT | Name homologue |
|---|---|
| AT5G23690 | >*A. thaliana*_AT5G23690.1#1 |
| AT5G23690 | >*A. thaliana*_AT1G28090.1#1 |
| AT5G23690 | >*A. thaliana*_AT3G48830.1#1 |
| AT5G23690 | >*M. truncatula*_AC151817_35.4#1 |
| AT5G23690 | >*O. sativa*_TC289531#1 |
| AT5G23690 | >*O. sativa*_TC310376#1 |
| AT5G23690 | >*P. patens*_161847#1 |
| AT5G23690 | >*P. trichocarpa*_scaff_XII.984#1 |
| AT5G23690 | >*P. trichocarpa*_scaff_XV.833#1 |
| AT5G23690 | >*V. vinifera* XM_002266778.1 hypothetical protein LOC100259104 (LOC100259104) |
| AT5G23690 | >*Z. mays*_TC467699#1 |
| AT5G23690 | >*Z. mays*_TC473496#1 |

Concerning AT5G53480 Polypeptide

TABLE A25

Preferred homologous polypeptides.

| iSYT | Name homologue |
|---|---|
| AT5G53480 | >AT5G53480.1 Symbols: importin beta-2, putative chr5: 21731242-21733935 FORWARD |
| AT5G53480 | >*A. thaliana*_AT3G08943.1#1 |
| AT5G53480 | >*A. thaliana*_AT3G08947.1#1 |
| AT5G53480 | >*G. max*_Glyma04g41230.1#1 |
| AT5G53480 | >*G. max*_Glyma05g36630.1#1 |
| AT5G53480 | >*G. max*_Glyma06g13620.1#1 |
| AT5G53480 | >*G. max*_Glyma08g02930.1#1 |
| AT5G53480 | >*H. vulgare*_c62767390hv270303@6375#1 |
| AT5G53480 | >*H. vulgare* AK249047 |

TABLE A25-continued

Preferred homologous polypeptides.

| iSYT | Name homologue |
|---|---|
| AT5G53480 | >*O. sativa*_LOC_Os12g38110.1#1 |
| AT5G53480 | >*P. patens*_TC30184#1 |
| AT5G53480 | >*P. patens*_TC31822#1 |
| AT5G53480 | >*P. trichocarpa*_scaff_VI.900#1 |
| AT5G53480 | >*P. trichocarpa*_scaff_XII.230#1 |
| AT5G53480 | >*P. trichocarpa*_scaff_XV.118#1 |
| AT5G53480 | >*P. trichocarpa*_scaff_XVI.1174#1 |
| AT5G53480 | >*S. bicolor*_XM_002442302.1 |

Concerning AT5G55210 Polypeptide

TABLE A26

Preferred homologous polypeptides.

| iSYT | Name homologue |
|---|---|
| AT5G55210 | >*A. thaliana*_AT5G55210.1#1 |
| AT5G55210 | >*A. thaliana*_AT4G22320.1#1 |
| AT5G55210 | >*B. napus*_EV025360#1 |
| AT5G55210 | >*B. napus*_TC65291#1 |
| AT5G55210 | >*B. napus*_TC67583#1 |
| AT5G55210 | >*B. napus*_TC68897#1 |
| AT5G55210 | >*B. napus*_TC93468#1 |
| AT5G55210 | >*G. max*_Glyma08g43440.1#1 |
| AT5G55210 | >*G. max*_Glyma09g01220.1#1 |
| AT5G55210 | >*G. max*_Glyma15g12050.1#1 |
| AT5G55210 | >*G. max*_Glyma18g10110.1#1 |
| AT5G55210 | >*H. vulgare*_BG342941#1 |
| AT5G55210 | >*H. vulgare*_TC167448#1 |
| AT5G55210 | >*M. truncatula*_TC122534#1 |
| AT5G55210 | >*M. truncatula*_TC127795#1 |
| AT5G55210 | >*O. sativa*_LOC_Os08g25080.1#1 |
| AT5G55210 | >*O. sativa*_LOC_Os08g25080.2#1 |
| AT5G55210 | >*O. sativa*_LOC_Os09g11240.1#1 |
| AT5G55210 | >*P. patens*_167013#1 |
| AT5G55210 | >*P. trichocarpa*_scaff_166.68#1 |
| AT5G55210 | >*P. trichocarpa*_scaff_I.2546#1 |
| AT5G55210 | >*P. trichocarpa*_scaff_XI.195#1 |
| AT5G55210 | >*T. aestivum*_CK204604#1 |
| AT5G55210 | >*T. aestivum*_TC293410#1 |
| AT5G55210 | >*Z. mays*_FL309643#1 |
| AT5G55210 | >*Z. mays*_TC479416#1 |

Example 16

Alignment of an iSYT Polypeptide and Homologues Thereof

Alignment of polypeptide sequences is performed using the ClustalW 2.0 algorithm of progressive alignment (Thompson et al. (1997) Nucleic Acids Res 25:4876-4882; Chenna et al. (2003). Nucleic Acids Res 31:3497-3500) with standard setting (slow alignment, similarity matrix: or Blosum 62 (if polypeptides are aligned), gap opening penalty 10, gap extension penalty: 0.2). Minor manual editing is done to further optimise the alignment. A phylogenetic tree of an iSYT polypeptide and homologues thereof is constructed using a neighbour-joining clustering algorithm as provided in the AlignX programme from the Vector NTI (Invitrogen).

Example 17

Calculation of Global Percentage Identity Between Polypeptide Sequences

Global percentages of similarity and identity between full length polypeptide sequences useful in performing the methods of the invention were determined using one of the methods available in the art, the MatGAT (Matrix Global Alignment Tool) software (BMC Bioinformatics. 2003 4:29. MatGAT: an application that generates similarity/identity matrices using protein or DNA sequences. Campanella J J, Bitincka L, Smalley J; software hosted by Ledion Bitincka). MatGAT software generates similarity/identity matrices for DNA or protein sequences without needing pre-alignment of the data. The program performs a series of pair-wise alignments using the Myers and Miller global alignment algorithm (with a gap opening penalty of 12, and a gap extension penalty of 2), calculates similarity and identity using for example Blosum 62 (for polypeptides), and then places the results in a distance matrix. Sequence similarity is shown in the bottom half of the dividing line and sequence identity is shown in the top half of the diagonal dividing line.

Parameters used in the comparison are: Scoring matrix: Blosum62, First Gap: 12, Extending Gap: 2.

Example 18

Identification of Domains Comprised in Polypeptide Sequences Useful in Performing the Methods of the Invention The Integrated Resource of Protein Families, Domains and Sites (InterPro) database is an integrated interface for the commonly used signature databases for text- and sequence-based searches. The InterPro database combines these databases, which use different methodologies and varying degrees of biological information about well-characterized proteins to derive protein signatures. Collaborating databases include SWISS-PROT, PROSITE, TrEMBL, PRINTS, Propom and Pfam, Smart and TIGRFAMs. Pfam is a large collection of multiple sequence alignments and hidden Markov models covering many common protein domains and families. Pfam is hosted at the Sanger Institute server in the United Kingdom. Interpro is hosted at the European Bioinformatics Institute in the United Kingdom.

The results of the InterPro scan of the polypeptide sequence representing the iSYT polypeptides of Table A are presented in Tables C1 to C20.

The term iSYT (interactor of SYT) and "AN3 interactor" as used herein are interchangeable.

TABLE C1

InterPro scan results (major accession numbers) of the AT1G05370 polypeptide.

| AN3 interactor | Database | Domain accession | Domain name | InterPro accession | amino acid start coordinate | amino acid end coordinate |
|---|---|---|---|---|---|---|
| AT1G05370.1 | TMHMM | tmhmm | transmembrane_regions | NULL | 170 | 191 |
| AT1G05370.1 | TMHMM | tmhmm | transmembrane_regions | NULL | 144 | 166 |
| AT1G05370.1 | Seg | seg | seg | NULL | 318 | 330 |
| AT1G05370.1 | Seg | seg | seg | NULL | 235 | 256 |
| AT1G05370.1 | Seg | seg | seg | NULL | 150 | 163 |
| AT1G05370.1 | HMMPanther | PTHR10174 | RETINALDEHYDE BINDING PROTEIN-RELATED | NULL | 18 | 150 |
| AT1G05370.1 | superfamily | SSF46938 | CRAL/TRIO N-terminal domain | IPR011074 | 14 | 83 |
| AT1G05370.1 | superfamily | SSF52087 | CRAL/TRIO domain | IPR001251 | 82 | 149 |
| AT1G05370.1 | ProfileScan | PS50191 | CRAL_TRIO | IPR001251 | 80 | 262 |
| AT1G05370.1 | HMMSmart | SM00516 | no description | IPR001251 | 86 | 229 |
| AT1G05370.1 | Gene3D | G3DSA:3.40.525.10 no | description | IPR001251 | 70 | 149 |
| AT1G08730.1 | superfamily | SSF54849 | GroEL-intermediate domain like | NULL | 940 | 1017 |

TABLE C2

InterPro scan results (major accession numbers) of the AT1G08730 polypeptide.

| AN3 interactor | Database | Domain accession | Domain name | InterPro accession | amino acid start coordinate | amino acid end coordinate |
|---|---|---|---|---|---|---|
| AT1G08730.1 | superfamily | SSF54849 | GroEL-intermediate domain like | NULL | 940 | 1017 |
| AT1G08730.1 | superfamily | SSF52540 | P-loop containing nucleoside triphosphate hydrolases | NULL | 798 | 893 |
| AT1G08730.1 | superfamily | SSF52540 | P-loop containing nucleoside triphosphate hydrolases | NULL | 38 | 797 |
| AT1G08730.1 | SignalPHMM | signalp | signal-peptide | NULL | 1 | 23 |
| AT1G08730.1 | Seg | seg | seg | NULL | 1191 | 1208 |
| AT1G08730.1 | Seg | seg | seg | NULL | 1015 | 1037 |
| AT1G08730.1 | Seg | seg | seg | NULL | 950 | 966 |
| AT1G08730.1 | Seg | seg | seg | NULL | 605 | 618 |
| AT1G08730.1 | HMMPanther | PTHR13140:SF36 | MYOSIN XI | NULL | 1130 | 1517 |
| AT1G08730.1 | HMMPanther | PTHR13140:SF36 | MYOSIN XI | NULL | 870 | 925 |
| AT1G08730.1 | HMMPanther | PTHR13140:SF36 | MYOSIN XI | NULL | 312 | 840 |
| AT1G08730.1 | HMMPanther | PTHR13140:SF36 | MYOSIN XI | NULL | 17 | 292 |
| AT1G08730.1 | HMMPanther | PTHR13140 | MYOSIN | NULL | 1130 | 1517 |
| AT1G08730.1 | HMMPanther | PTHR13140 | MYOSIN | NULL | 870 | 925 |
| AT1G08730.1 | HMMPanther | PTHR13140 | MYOSIN | NULL | 312 | 840 |
| AT1G08730.1 | HMMPanther | PTHR13140 | MYOSIN | NULL | 17 | 292 |
| AT1G08730.1 | Gene3D | G3DSA:4.10.270.20no | description | NULL | 726 | 771 |

TABLE C2-continued

InterPro scan results (major accession numbers) of the AT1G08730 polypeptide.

| AN3 interactor | Database | Domain accession | Domain name | InterPro accession | amino acid start coordinate | amino acid end coordinate |
|---|---|---|---|---|---|---|
| AT1G08730.1 | Gene3D | G3DSA:3.30.538.10no | description | NULL | 71 | 304 |
| AT1G08730.1 | Gene3D | G3DSA:3.30.1370.40no | description | NULL | 655 | 721 |
| AT1G08730.1 | Gene3D | G3DSA:1.10.465.10no | description | NULL | 446 | 628 |
| AT1G08730.1 | Gene3D | G3DSA:1.10.183.10no | description | NULL | 320 | 428 |
| AT1G08730.1 | superfamily | SSF50084 | Myosin S1 fragment, N-terminal domain | IPR008989 | 13 | 37 |
| AT1G08730.1 | HMMPfam | PF02736 | Myosin_N | IPR004009 | 18 | 59 |
| AT1G08730.1 | ProfileScan | PS51126 | DILUTE | IPR002710 | 1168 | 1481 |
| AT1G08730.1 | HMMPfam | PF01843 | DIL | IPR002710 | 1356 | 1463 |
| AT1G08730.1 | BlastProDom | PD003376 | Q6ZGC5_EEEEE_Q6ZGC5; | IPR002710 | 1287 | 1434 |
| AT1G08730.1 | HMMSmart | SM00242 | no description | IPR001609 | 64 | 741 |
| AT1G08730.1 | HMMPfam | PF00063 | Myosin_head | IPR001609 | 72 | 728 |
| AT1G08730.1 | FPrintScan | PR00193 | MYOSINHEAVY | IPR001609 | 490 | 518 |
| AT1G08730.1 | FPrintScan | PR00193 | MYOSINHEAVY | IPR001609 | 437 | 465 |
| AT1G08730.1 | FPrintScan | PR00193 | MYOSINHEAVY | IPR001609 | 204 | 231 |
| AT1G08730.1 | FPrintScan | PR00193 | MYOSINHEAVY | IPR001609 | 157 | 182 |
| AT1G08730.1 | FPrintScan | PR00193 | MYOSINHEAVY | IPR001609 | 100 | 119 |
| AT1G08730.1 | BlastProDom | PD000355 | Q9ZVN3_ARATH_Q9ZVN3; | IPR001609 | 196 | 226 |
| AT1G08730.1 | ProfileScan | PS50096 | IQ | IPR000048 | 862 | 891 |
| AT1G08730.1 | ProfileScan | PS50096 | IQ | IPR000048 | 839 | 866 |
| AT1G08730.1 | ProfileScan | PS50096 | IQ | IPR000048 | 814 | 843 |
| AT1G08730.1 | ProfileScan | PS50096 | IQ | IPR000048 | 791 | 818 |
| AT1G08730.1 | ProfileScan | PS50096 | IQ | IPR000048 | 766 | 795 |
| AT1G08730.1 | ProfileScan | PS50096 | IQ | IPR000048 | 743 | 772 |
| AT1G08730.1 | HMMSmart | SM00015 | no description | IPR000048 | 861 | 883 |
| AT1G08730.1 | HMMSmart | SM00015 | no description | IPR000048 | 838 | 860 |
| AT1G08730.1 | HMMSmart | SM00015 | no description | IPR000048 | 813 | 835 |
| AT1G08730.1 | HMMSmart | SM00015 | no description | IPR000048 | 790 | 812 |
| AT1G08730.1 | HMMSmart | SM00015 | no description | IPR000048 | 765 | 787 |
| AT1G08730.1 | HMMSmart | SM00015 | no description | IPR000048 | 742 | 764 |
| AT1G08730.1 | HMMPfam | PF00612 | IQ | IPR000048 | 840 | 860 |
| AT1G08730.1 | HMMPfam | PF00612 | IQ | IPR000048 | 815 | 835 |
| AT1G08730.1 | HMMPfam | PF00612 | IQ | IPR000048 | 792 | 812 |
| AT1G08730.1 | HMMPfam | PF00612 | IQ | IPR000048 | 767 | 787 |
| AT1G08730.1 | HMMPfam | PF00612 | IQ | IPR000048 | 744 | 764 |

TABLE C3

InterPro scan results (major accession numbers) of the AT1G09270 polypeptide.

| AN3 interactor | Database | Domain accession | Domain name | InterPro accession | amino acid start coordinate | amino acid end coordinate |
|---|---|---|---|---|---|---|
| AT1G09270.1 | HMMPanther | PTHR23316 | PTHR23316 | NULL | 1 | 537 |
| AT1G09270.1 | HMMPanther | PTHR23316 | PTHR23316 | NULL | 1 | 537 |
| AT1G09270.1 | superfamily | SSF48371 | ARM-type_fold | IPR016024 | 49 | 501 |
| AT1G09270.1 | Gene3D | G3DSA:1.25.10.10ARM-like | | IPR011989 | 81 | 501 |
| AT1G09270.1 | ProfileScan | PS51214 | IBB | IPR002652 | 1 | 58 |
| AT1G09270.1 | HMMPfam | PF01749 | IBB | IPR002652 | 4 | 102 |
| AT1G09270.1 | Gene3D | G3DSA:1.20.5.690Importin-a-like_IBB-bd | | IPR002652 | 9 | 52 |
| AT1G09270.1 | ProfileScan | PS50176 | ARM_REPEAT | IPR000225 | 333 | 376 |
| AT1G09270.1 | ProfileScan | PS50176 | ARM_REPEAT | IPR000225 | 165 | 207 |
| AT1G09270.1 | ProfileScan | PS50176 | ARM_REPEAT | IPR000225 | 122 | 165 |
| AT1G09270.1 | HMMSmart | SM00185 | ARM | IPR000225 | 408 | 448 |
| AT1G09270.1 | HMMSmart | SM00185 | ARM | IPR000225 | 365 | 405 |
| AT1G09270.1 | HMMSmart | SM00185 | ARM | IPR000225 | 322 | 363 |
| AT1G09270.1 | HMMSmart | SM00185 | ARM | IPR000225 | 280 | 320 |
| AT1G09270.1 | HMMSmart | SM00185 | ARM | IPR000225 | 239 | 278 |
| AT1G09270.1 | HMMSmart | SM00185 | ARM | IPR000225 | 195 | 237 |
| AT1G09270.1 | HMMSmart | SM00185 | ARM | IPR000225 | 154 | 194 |
| AT1G09270.1 | HMMSmart | SM00185 | ARM | IPR000225 | 111 | 152 |
| AT1G09270.1 | HMMPfam | PF00514 | Arm | IPR000225 | 408 | 448 |
| AT1G09270.1 | HMMPfam | PF00514 | Arm | IPR000225 | 365 | 405 |
| AT1G09270.1 | HMMPfam | PF00514 | Arm | IPR000225 | 322 | 363 |
| AT1G09270.1 | HMMPfam | PF00514 | Arm | IPR000225 | 280 | 320 |
| AT1G09270.1 | HMMPfam | PF00514 | Arm | IPR000225 | 239 | 278 |
| AT1G09270.1 | HMMPfam | PF00514 | Arm | IPR000225 | 196 | 237 |
| AT1G09270.1 | HMMPfam | PF00514 | Arm | IPR000225 | 154 | 194 |
| AT1G09270.1 | HMMPfam | PF00514 | Arm | IPR000225 | 111 | 152 |

TABLE C4

InterPro scan results (major accession numbers) of the AT1G18450. polypeptide.

| AN3 interactor | Database | Domain accession | Domain name | InterPro accession | amino acid start coordinate | amino acid end coordinate |
|---|---|---|---|---|---|---|
| AT1G18450.1 | superfamily | SSF53067 | SSF53067 | NULL | 170 | 441 |
| AT1G18450.1 | HMMPanther | PTHR11937:SF32 | PTHR11937:SF32 | NULL | 254 | 441 |
| AT1G18450.1 | superfamily | SSF53067 | SSF53067 | NULL | 3 | 170 |
| AT1G18450.1 | HMMPanther | PTHR11937:SF32 | PTHR11937:SF32 | NULL | 74 | 223 |
| AT1G18450.1 | HMMPanther | PTHR11937:SF32 | PTHR11937:SF32 | NULL | 31 | 441 |
| AT1G18450.1 | HMMPanther | PTHR11937:SF32 | PTHR11937:SF32 | NULL | 31 | 52 |
| AT1G18450.1 | Gene3D | G3DSA:3.30.420.40G3DSA:3.30.420.40 | | NULL | 404 | 441 |
| AT1G18450.1 | Gene3D | G3DSA:3.30.420.40G3DSA:3.30.420.40 | | NULL | 296 | 387 |
| AT1G18450.1 | Gene3D | G3DSA:3.30.420.40G3DSA:3.30.420.40 | | NULL | 3 | 164 |
| AT1G18450.1 | HMMSmart | SM00268 | ACTIN | IPR004000 | 7 | 441 |
| AT1G18450.1 | HMMPfam | PF00022 | Actin | IPR004000 | 4 | 441 |
| AT1G18450.1 | HMMPanther | PTHR11937 | Actin_like | IPR004000 | 31 | 441 |

TABLE C5

InterPro scan results (major accession numbers) of the AT1G20670 polypeptide.

| AN3 interactor | Database | Domain accession | Domain name | InterPro accession | amino acid start coordinate | amino acid end coordinate |
|---|---|---|---|---|---|---|
| AT1G20670.1 | HMMPanther | PTHR22881:SF3 | PTHR22881:SF3 | NULL | 173 | 652 |
| AT1G20670.1 | HMMPanther | PTHR22881:SF3 | PTHR22881:SF3 | NULL | 173 | 652 |
| AT1G20670.1 | HMMPanther | PTHR22881 | PTHR22881 | NULL | 173 | 652 |
| AT1G20670.1 | HMMPanther | PTHR22881 | PTHR22881 | NULL | 173 | 652 |
| AT1G20670.1 | superfamily | SSF47370 | Bromodomain | IPR001487 | 145 | 288 |
| AT1G20670.1 | ProfileScan | PS50014 | BROMODOMAIN_2 | IPR001487 | 188 | 258 |
| AT1G20670.1 | ProfileScan | PS00633 | BROMODOMAIN_1 | IPR001487 | 194 | 250 |
| AT1G20670.1 | HMMSmart | SM00297 | BROMO | IPR001487 | 169 | 277 |
| AT1G20670.1 | HMMPfam | PF00439 | Bromodomain | IPR001487 | 176 | 263 |
| AT1G20670.1 | Gene3D | G3DSA:1.20.920.10Bromodomain | | IPR001487 | 152 | 306 |
| AT1G20670.1 | FPrintScan | PR00503 | BROMODOMAIN | IPR001487 | 239 | 258 |
| AT1G20670.1 | FPrintScan | PR00503 | BROMODOMAIN | IPR001487 | 221 | 239 |
| AT1G20670.1 | FPrintScan | PR00503 | BROMODOMAIN | IPR001487 | 205 | 221 |

TABLE C6

InterPro scan results (major accession numbers) of the AT1G21700 polypeptide.

| AN3 interactor | Database | Domain accession | Domain name | InterPro accession | amino acid start coordinate | amino acid end coordinate |
|---|---|---|---|---|---|---|
| AT1G21700.1 | HMMPanther | PTHR12802:SF4 | PTHR12802:SF4 | NULL | 175 | 807 |
| AT1G21700.1 | HMMPanther | PTHR12802:SF4 | PTHR12802:SF4 | NULL | 175 | 807 |
| AT1G21700.1 | HMMPanther | PTHR12802 | PTHR12802 | NULL | 175 | 807 |
| AT1G21700.1 | HMMPanther | PTHR12802 | PTHR12802 | NULL | 175 | 807 |
| AT1G21700.1 | HMMPfam | PF00249 | Myb_DNA-binding | IPR014778 | 400 | 445 |
| AT1G21700.1 | superfamily | SSF46689 | Homeodomain_like | IPR009057 | 394 | 447 |
| AT1G21700.1 | ProfileScan | PS50934 | SWIRM | IPR007526 | 176 | 274 |
| AT1G21700.1 | HMMPfam | PF04433 | SWIRM | IPR007526 | 176 | 265 |
| AT1G21700.1 | ProfileScan | PS50090 | MYB_3 | IPR001005 | 402 | 445 |
| AT1G21700.1 | HMMSmart | SM00717 | SANT | IPR001005 | 399 | 447 |

TABLE C7

InterPro scan results (major accession numbers) of the AT1G23900 polypeptide.

| AN3 interactor | Database | Domain accession | Domain name | InterPro accession | amino acid start coordinate | amino acid end coordinate |
|---|---|---|---|---|---|---|
| AT1G23900.2 | HMMPanther | PTHR22780:SF5 | PTHR22780:SF5 | NULL | 10 | 876 |
| AT1G23900.2 | HMMPanther | PTHR22780:SF5 | PTHR22780:SF5 | NULL | 10 | 876 |
| AT1G23900.2 | HMMPanther | PTHR22780 | PTHR22780 | NULL | 10 | 876 |

TABLE C7-continued

InterPro scan results (major accession numbers) of the AT1G23900 polypeptide.

| AN3 interactor | Database | Domain accession | Domain name | InterPro accession | amino acid start coordinate | amino acid end coordinate |
|---|---|---|---|---|---|---|
| AT1G23900.2 | HMMPanther | PTHR22780 | PTHR22780 | NULL | 10 | 876 |
| AT1G23900.2 | HMMPIR | PIRSF037094 | AP1_complex_gamma | IPR017107 | 1 | 876 |
| AT1G23900.2 | superfamily | SSF48371 | ARM-type_fold | IPR016024 | 6 | 591 |
| AT1G23900.2 | superfamily | SSF49348 | Clath_adapt | IPR013041 | 726 | 873 |
| AT1G23900.2 | Gene3D | G3DSA:1.25.10.10ARM-like | | IPR011989 | 9 | 572 |
| AT1G23900.2 | ProfileScan | PS50180 | GAE | IPR008153 | 756 | 873 |
| AT1G23900.2 | Gene3D | G3DSA:2.60.40.1230 Clathrin g-adaptin_app | | IPR008153 | 757 | 873 |
| AT1G23900.2 | BlastProDom | PD021457 | Gamma_adaptin_C | IPR008153 | 760 | 873 |
| AT1G23900.2 | HMMSmart | SM00809 | Alpha_adaptinC2 | IPR008152 | 753 | 873 |
| AT1G23900.2 | HMMPfam | PF02883 | Alpha_adaptinC2 | IPR008152 | 753 | 873 |
| AT1G23900.2 | HMMPfam | PF01602 | Adaptin_N | IPR002553 | 26 | 580 |

TABLE C8

InterPro scan results (major accession numbers) of the AT1G65980 polypeptide.

| AN3 interactor | Database | Domain accession | Domain name | InterPro accession | amino acid start coordinate | amino acid end coordinate |
|---|---|---|---|---|---|---|
| AT1G65980.2 | HMMPanther | PTHR10430:SF4 | PTHR10430:SF4 | NULL | 1 | 104 |
| AT1G65980.2 | HMMPanther | PTHR10430:SF4 | PTHR10430:SF4 | NULL | 1 | 104 |
| AT1G65980.2 | HMMPanther | PTHR10430 | PTHR10430 | NULL | 1 | 104 |
| AT1G65980.2 | HMMPanther | PTHR10430 | PTHR10430 | NULL | 1 | 104 |
| AT1G65980.2 | HMMPfam | PF08534 | Redoxin | IPR013740 | 5 | 120 |
| AT1G65980.2 | superfamily | SSF52833 | Thiordxn-like_fd | IPR012336 | 4 | 103 |
| AT1G65980.2 | | Gene3D | G3DSA:3.40.30.10Thioredoxin_fold | IPR012335 | 2 | 104 |

TABLE C9

InterPro scan results (major accession numbers) of the AT2G18876 polypeptide.

| AN3 interactor | Database | Domain accession | Domain name | InterPro accession | amino acid start coordinate | amino acid end coordinate |
|---|---|---|---|---|---|---|
| AT2G18876.2 | HMMPanther | PTHR21736:SF12 | PTHR21736:SF12 | NULL | 64 | 284 |
| AT2G18876.2 | HMMPanther | PTHR21736:SF12 | PTHR21736:SF12 | NULL | 64 | 284 |
| AT2G18876.2 | HMMPanther | PTHR21736 | PTHR21736 | NULL | 64 | 284 |
| AT2G18876.2 | HMMPanther | PTHR21736 | PTHR21736 | NULL | 64 | 284 |

TABLE C10

InterPro scan results (major accession numbers) of the AT2G46020 polypeptide.

| AN3 interactor | Database | Domain accession | Domain name | InterPro accession | amino acid start coordinate | amino acid end coordinate |
|---|---|---|---|---|---|---|
| AT2G46020.2 | superfamily | SSF52540 | SSF52540 | NULL | 1300 | 1434 |
| AT2G46020.2 | superfamily | SSF52540 | SSF52540 | NULL | 758 | 1157 |
| AT2G46020.2 | HMMPanther | PTHR10799:SF76 | PTHR10799:SF76 | NULL | 1465 | 1721 |
| AT2G46020.2 | HMMPanther | PTHR10799:SF76 | PTHR10799:SF76 | NULL | 965 | 1430 |
| AT2G46020.2 | HMMPanther | PTHR10799:SF76 | PTHR10799:SF76 | NULL | 202 | 217 |
| AT2G46020.2 | HMMPanther | PTHR10799:SF76 | PTHR10799:SF76 | NULL | 24 | 1721 |
| AT2G46020.2 | HMMPanther | PTHR10799:SF76 | PTHR10799:SF76 | NULL | 24 | 74 |
| AT2G46020.2 | HMMPanther | PTHR10799 | PTHR10799 | NULL | 1465 | 1721 |
| AT2G46020.2 | HMMPanther | PTHR10799 | PTHR10799 | NULL | 965 | 1430 |
| AT2G46020.2 | HMMPanther | PTHR10799 | PTHR10799 | NULL | 202 | 217 |
| AT2G46020.2 | HMMPanther | PTHR10799 | PTHR10799 | NULL | 24 | 1721 |
| AT2G46020.2 | HMMPanther | PTHR10799 | PTHR10799 | NULL | 24 | 74 |
| AT2G46020.2 | Gene3D | G3DSA:3.40.50.300G3DSA:3.40.50.300 | | NULL | 1309 | 1444 |
| AT2G46020.2 | HMMPfam | PF08880 | | QLQ | IPR014978 | 462 | 499 |

TABLE C10-continued

InterPro scan results (major accession numbers) of the AT2G46020 polypeptide.

| AN3 interactor | Database | Domain accession | Domain name | InterPro accession | amino acid start coordinate | amino acid end coordinate |
|---|---|---|---|---|---|---|
| AT2G46020.2 | ProfileScan | PS51192 | HELICASE_ATP_BIND_1 | IPR014021 | 993 | 1158 |
| AT2G46020.2 | HMMSmart | SM00487 | DEXDc | IPR014001 | 977 | 1166 |
| AT2G46020.2 | ProfileScan | PS51194 | HELICASE_CTER | IPR001650 | 1312 | 1489 |
| AT2G46020.2 | HMMSmart | SM00490 | HELICc | IPR001650 | 1338 | 1422 |
| AT2G46020.2 | HMMPfam | PF00271 | Helicase_C | IPR001650 | 1343 | 1422 |
| AT2G46020.2 | superfamily | SSF47370 | Bromodomain | IPR001487 | 1890 | 2010 |
| AT2G46020.2 | HMMSmart | SM00297 | BROMO | IPR001487 | 1900 | 2007 |
| AT2G46020.2 | Gene3D | G3DSA:1.20.920.10Bromodomain | | IPR001487 | 1889 | 2003 |
| AT2G46020.2 | HMMPfam | PF00176 | SNF2_N | IPR000330 | 984 | 1291 |

TABLE C11

InterPro scan results (major accession numbers) of the AT3G06720 polypeptide.

| AN3 interactor | Database | Domain accession | Domain name | InterPro accession | amino acid start coordinate | amino acid end coordinate |
|---|---|---|---|---|---|---|
| AT3G06720.1 | HMMPanther | PTHR23316 | PTHR23316 | NULL | 1 | 531 |
| AT3G06720.1 | HMMPanther | PTHR23316 | PTHR23316 | NULL | 1 | 531 |
| AT3G06720.1 | superfamily | SSF48371 | ARM-type_fold | IPR016024 | 43 | 494 |
| AT3G06720.1 | Gene3D | G3DSA:1.25.10.10ARM-like | | IPR011989 | 72 | 494 |
| AT3G06720.1 | ProfileScan | PS51214 | IBB | IPR002652 | 1 | 58 |
| AT3G06720.1 | HMMPfam | PF01749 | IBB | IPR002652 | 4 | 95 |
| AT3G06720.1 | ProfileScan | PS50176 | ARM_REPEAT | IPR000225 | 326 | 361 |
| AT3G06720.1 | ProfileScan | PS50176 | ARM_REPEAT | IPR000225 | 242 | 284 |
| AT3G06720.1 | ProfileScan | PS50176 | ARM_REPEAT | IPR000225 | 158 | 186 |
| AT3G06720.1 | ProfileScan | PS50176 | ARM_REPEAT | IPR000225 | 115 | 154 |
| AT3G06720.1 | HMMSmart | SM00185 | ARM | IPR000225 | 401 | 441 |
| AT3G06720.1 | HMMSmart | SM00185 | ARM | IPR000225 | 358 | 398 |
| AT3G06720.1 | HMMSmart | SM00185 | ARM | IPR000225 | 315 | 356 |
| AT3G06720.1 | HMMSmart | SM00185 | ARM | IPR000225 | 273 | 313 |
| AT3G06720.1 | HMMSmart | SM00185 | ARM | IPR000225 | 232 | 271 |
| AT3G06720.1 | HMMSmart | SM00185 | ARM | IPR000225 | 188 | 230 |
| AT3G06720.1 | HMMSmart | SM00185 | ARM | IPR000225 | 147 | 187 |
| AT3G06720.1 | HMMSmart | SM00185 | ARM | IPR000225 | 104 | 145 |
| AT3G06720.1 | HMMPfam | PF00514 | Arm | IPR000225 | 401 | 441 |
| AT3G06720.1 | HMMPfam | PF00514 | Arm | IPR000225 | 358 | 398 |
| AT3G06720.1 | HMMPfam | PF00514 | Arm | IPR000225 | 315 | 356 |
| AT3G06720.1 | HMMPfam | PF00514 | Arm | IPR000225 | 273 | 313 |
| AT3G06720.1 | HMMPfam | PF00514 | Arm | IPR000225 | 232 | 271 |
| AT3G06720.1 | HMMPfam | PF00514 | Arm | IPR000225 | 189 | 230 |
| AT3G06720.1 | HMMPfam | PF00514 | Arm | IPR000225 | 147 | 187 |
| AT3G06720.1 | HMMPfam | PF00514 | Arm | IPR000225 | 104 | 145 |

TABLE C12

InterPro scan results (major accession numbers) of the AT3G15000 polypeptide.

| AN3 interactor | Database | Domain accession | Domain name | InterPro accession | amino acid start coordinate | amino acid end coordinate |
|---|---|---|---|---|---|---|
| AT3G15000.1 | Seg | seg | seg | NULL | 311 | 385 |
| AT3G15000.1 | Seg | seg | seg | NULL | 280 | 302 |
| AT3G15000.1 | Seg | seg | seg | NULL | 239 | 278 |
| AT3G15000.1 | Seg | seg | seg | NULL | 206 | 229 |
| AT3G15000.1 | Seg | seg | seg | NULL | 25 | 50 |

TABLE C13

InterPro scan results (major accession numbers) of the AT3G60830 polypeptide.

| AN3 interactor | Database | Domain accession | Domain name | InterPro accession | amino acid start coordinate | amino acid end coordinate |
|---|---|---|---|---|---|---|
| AT3G60830.1 | superfamily | SSF53067 | SSF53067 | NULL | 135 | 363 |
| AT3G60830.1 | superfamily | SSF53067 | SSF53067 | NULL | 1 | 141 |

TABLE C13-continued

InterPro scan results (major accession numbers) of the AT3G60830 polypeptide.

| AN3 interactor | Database | Domain accession | Domain name | InterPro accession | amino acid start coordinate | amino acid end coordinate |
|---|---|---|---|---|---|---|
| AT3G60830.1 | HMMPanther | PTHR11937:SF26 | PTHR11937:SF26 | NULL | 20 | 363 |
| AT3G60830.1 | HMMPanther | PTHR11937:SF26 | PTHR11937:SF26 | NULL | 20 | 363 |
| AT3G60830.1 | Gene3D | G3DSA:3.30.420.40G3DSA:3.30.420.40 | | NULL | 325 | 363 |
| AT3G60830.1 | Gene3D | G3DSA:3.30.420.40G3DSA:3.30.420.40 | | NULL | 228 | 300 |
| AT3G60830.1 | Gene3D | G3DSA:3.30.420.40G3DSA:3.30.420.40 | | NULL | 3 | 128 |
| AT3G60830.1 | HMMSmart | SM00268 | ACTIN | IPR004000 | 1 | 363 |
| AT3G60830.1 | HMMPfam | PF00022 | Actin | IPR004000 | 3 | 363 |
| AT3G60830.1 | HMMPanther | PTHR11937 | Actin_like | IPR004000 | 20 | 363 |
| AT3G60830.1 | FPrintScan | PR00190 | ACTIN | IPR004000 | 219 | 235 |
| AT3G60830.1 | FPrintScan | PR00190 | ACTIN | IPR004000 | 128 | 147 |
| AT3G60830.1 | FPrintScan | PR00190 | ACTIN | IPR004000 | 103 | 116 |
| AT3G60830.1 | FPrintScan | PR00190 | ACTIN | IPR004000 | 23 | 32 |

TABLE C14

InterPro scan results (major accession numbers) of the AT4G16143 polypeptide.

| AN3 interactor | Database | Domain accession | Domain name | InterPro accession | amino acid start coordinate | amino acid end coordinate |
|---|---|---|---|---|---|---|
| AT4G16143.1 | Seg | seg | seg | NULL | 333 | 340 |
| AT4G16143.1 | HMMPanther | PTHR23316 | IMPORTIN ALPHA | NULL | 1 | 534 |
| AT4G16143.1 | superfamily | SSF48371 | ARM repeat | IPR016024 | 77 | 499 |
| AT4G16143.1 | Gene3D | G3DSA:1.25.10.10no | description | IPR011989 | 77 | 499 |
| AT4G16143.1 | ProfileScan | PS51214 | IBB | IPR002652 | 1 | 58 |
| AT4G16143.1 | HMMPfam | PF01749 | IBB | IPR002652 | 4 | 100 |
| AT4G16143.1 | ProfileScan | PS50176 | ARM_REPEAT | IPR000225 | 331 | 374 |
| AT4G16143.1 | ProfileScan | PS50176 | ARM_REPEAT | IPR000225 | 289 | 331 |
| AT4G16143.1 | ProfileScan | PS50176 | ARM_REPEAT | IPR000225 | 247 | 289 |
| AT4G16143.1 | ProfileScan | PS50176 | ARM_REPEAT | IPR000225 | 163 | 205 |
| AT4G16143.1 | ProfileScan | PS50176 | ARM_REPEAT | IPR000225 | 120 | 163 |
| AT4G16143.1 | HMMSmart | SM00185 | no description | IPR000225 | 406 | 446 |
| AT4G16143.1 | HMMSmart | SM00185 | no description | IPR000225 | 363 | 403 |
| AT4G16143.1 | HMMSmart | SM00185 | no description | IPR000225 | 320 | 361 |
| AT4G16143.1 | HMMSmart | SM00185 | no description | IPR000225 | 278 | 318 |
| AT4G16143.1 | HMMSmart | SM00185 | no description | IPR000225 | 237 | 276 |
| AT4G16143.1 | HMMSmart | SM00185 | no description | IPR000225 | 193 | 235 |
| AT4G16143.1 | HMMSmart | SM00185 | no description | IPR000225 | 152 | 192 |
| AT4G16143.1 | HMMSmart | SM00185 | no description | IPR000225 | 109 | 150 |
| AT4G16143.1 | HMMPfam | PF00514 | Arm | IPR000225 | 406 | 446 |
| AT4G16143.1 | HMMPfam | PF00514 | Arm | IPR000225 | 363 | 403 |
| AT4G16143.1 | HMMPfam | PF00514 | Arm | IPR000225 | 320 | 361 |
| AT4G16143.1 | HMMPfam | PF00514 | Arm | IPR000225 | 278 | 318 |
| AT4G16143.1 | HMMPfam | PF00514 | Arm | IPR000225 | 237 | 276 |
| AT4G16143.1 | HMMPfam | PF00514 | Arm | IPR000225 | 194 | 235 |
| AT4G16143.1 | HMMPfam | PF00514 | Arm | IPR000225 | 152 | 192 |
| AT4G16143.1 | HMMPfam | PF00514 | Arm | IPR000225 | 109 | 150 |

TABLE C15

InterPro scan results (major accession numbers) of the AT4G21540 polypeptide.

| AN3 interactor | Database | Domain accession | Domain name | InterPro accession | amino acid start coordinate | amino acid end coordinate |
|---|---|---|---|---|---|---|
| AT4G21540.1 | SignalPHMM | signalp | signal-peptide | NULL | 1 | 30 |
| AT4G21540.1 | Seg | seg | seg | NULL | 226 | 236 |
| AT4G21540.1 | Seg | seg | seg | NULL | 19 | 37 |
| AT4G21540.1 | HMMPanther | PTHR12358:SF10 | SPHINGOSINE KINASE-RELATED | NULL | 373 | 747 |
| AT4G21540.1 | HMMPanther | PTHR12358 | SPHINGOSINE KINASE | NULL | 373 | 747 |
| AT4G21540.1 | HMMSmart | SM00046 | no description | IPR001206 | 909 | 1041 |
| AT4G21540.1 | HMMSmart | SM00046 | no description | IPR001206 | 379 | 515 |
| AT4G21540.1 | HMMPfam | PF00781 | DAGK_cat | IPR001206 | 909 | 1041 |
| AT4G21540.1 | HMMPfam | PF00781 | DAGK_cat | IPR001206 | 379 | 515 |

TABLE C15-continued

InterPro scan results (major accession numbers) of the AT4G21540 polypeptide.

| AN3 interactor | Database | Domain accession | Domain name | InterPro accession | amino acid start coordinate | amino acid end coordinate |
|---|---|---|---|---|---|---|
| AT4G21540.1 | BlastProDom | PD005043 | O65419__ARATH_O65419; | IPR001206 | 908 | 1018 |
| AT4G21540.1 | BlastProDom | PD005043 | O65419__ARATH_O65419; | IPR001206 | 378 | 488 |

TABLE C16

InterPro scan results (major accession numbers) of the AT4G27550 polypeptide.

| AN3 interactor | Database | Domain accession | Domain name | InterPro accession | amino acid start coordinate | amino acid end coordinate |
|---|---|---|---|---|---|---|
| AT4G27550.1 | superfamily | SSF56784 | SSF56784 | NULL | 511 | 790 |
| AT4G27550.1 | superfamily | SSF53756 | SSF53756 | NULL | 4 | 467 |
| AT4G27550.1 | HMMPanther | PTHR10788 | PTHR10788 | NULL | 68 | 730 |
| AT4G27550.1 | HMMPanther | PTHR10788 | PTHR10788 | NULL | 68 | 730 |
| AT4G27550.1 | Gene3D | G3DSA:3.40.50.2000G3DSA:3.40.50.2000 | | NULL | 247 | 452 |
| AT4G27550.1 | HMMTigr | TIGR00685 | T6PP | IPR003337 | 508 | 791 |
| AT4G27550.1 | HMMPfam | PF02358 | Trehalose_PPase | IPR003337 | 514 | 758 |
| AT4G27550.1 | HMMPfam | PF00982 | Glyco_transf_20 | IPR001830 | 4 | 469 |

TABLE C17

InterPro scan results (major accession numbers) of the AT5G13030 polypeptide.

| AN3 interactor | Database | Domain accession | Domain name | InterPro accession | amino acid start coordinate | amino acid end coordinate |
|---|---|---|---|---|---|---|
| AT5G13030.1 | HMMPfam | PF02696 | UPF0061 | IPR003846 | 108 | 604 |
| AT5G14170.1 | HMMPanther | PTHR13844 | PTHR13844 | NULL | 250 | 523 |
| AT5G14170.1 | HMMPanther | PTHR13844 | PTHR13844 | NULL | 250 | 523 |
| AT5G14170.1 | superfamily | SSF47592 | MDM2 | IPR003121 | 308 | 400 |
| AT5G14170.1 | HMMPfam | PF02201 | SWIB | IPR003121 | 315 | 390 |
| AT5G14170.1 | Gene3D | G3DSA:1.10.245.10SWIB_MDM2 | | IPR003121 | 308 | 400 |

TABLE C18

InterPro scan results (major accession numbers) of the AT5G17510 polypeptide.

| AN3 interactor | Database | Domain accession | Domain name | InterPro accession | amino acid start coordinate | amino acid end coordinate |
|---|---|---|---|---|---|---|
| AT5G17510.1 | Seg | seg | seg | NULL | 343 | 357 |
| AT5G17510.1 | Seg | seg | seg | NULL | 70 | 121 |
| AT5G17510.1 | Seg | seg | seg | NULL | 15 | 51 |
| AT5G17510.1 | superfamily | SSF47175 | Cytochromes | IPR010980 | 12 | 151 |

TABLE C19

InterPro scan results (major accession numbers) of the AT5G23690 polypeptide.

| AN3 interactor | Database | Domain accession | Domain name | InterPro accession | amino acid start coordinate | amino acid end coordinate |
|---|---|---|---|---|---|---|
| AT5G23690.1 | superfamily | SSF81891 | Poly A polymerase C-terminal region-like | NULL | 224 | 443 |
| AT5G23690.1 | superfamily | SSF81301 | Nucleotidyltransferase | NULL | 76 | 223 |
| AT5G23690.1 | Seg | seg | seg | NULL | 240 | 252 |
| AT5G23690.1 | HMMPanther | PTHR13734:SF12 | POLY(A) POLYMERASE, *ARABIDOPSIS* | NULL | 112 | 523 |

TABLE C19-continued

InterPro scan results (major accession numbers) of the AT5G23690 polypeptide.

| AN3 interactor | Database | Domain accession | Domain name | InterPro accession | amino acid start coordinate | amino acid end coordinate |
|---|---|---|---|---|---|---|
| AT5G23690.1 | HMMPanther | PTHR13734 | TRNA-NUCLEO-TIDYLTRANSFERASE/POLY(A) POLYMERASE FAMILY MEMBER | NULL | 112 | 523 |
| AT5G23690.1 | Gene3D | G3DSA:3.30.460.10no description | | NULL | 66 | 223 |
| AT5G23690.1 | Gene3D | G3DSA:1.10.3090.10no description | | NULL | 224 | 316 |
| AT5G23690.1 | ScanRegExp | PS00012 | PHOSPHOPANTETHEINE | IPR006162 | 71 | 86 |
| AT5G23690.1 | HMMPfam | PF01743 | PolyA_pol | IPR002646 | 97 | 226 |
| AT5G23690.1 | ScanRegExp | PS00014 | ER_TARGET | IPR000886 | 524 | 527 |

TABLE C20

InterPro scan results (major accession numbers) of the AT5G53480 polypeptide.

| AN3 interactor | Database | Domain accession | Domain name | InterPro accession | amino acid start coordinate | amino acid end coordinate |
|---|---|---|---|---|---|---|
| AT5G53480.1 | HMMPanther | PTHR10527:SF1 | PTHR10527:SF1 | NULL | 217 | 869 |
| AT5G53480.1 | HMMPanther | PTHR10527:SF1 | PTHR10527:SF1 | NULL | 217 | 869 |
| AT5G53480.1 | HMMPanther | PTHR10527 | PTHR10527 | NULL | 217 | 869 |
| AT5G53480.1 | HMMPanther | PTHR10527 | PTHR10527 | NULL | 217 | 869 |
| AT5G53480.1 | superfamily | SSF48371 | ARM-type_fold | IPR016024 | 3 | 864 |
| AT5G53480.1 | Gene3D | G3DSA:1.25.10.10ARM-like | | IPR011989 | 3 | 866 |
| AT5G53480.1 | ProfileScan | PS50166 | IMPORTIN_B_NT | IPR001494 | 23 | 103 |
| AT5G53480.1 | HMMPfam | PF03810 | IBN_N | IPR001494 | 23 | 103 |
| AT5G53480.1 | HMMPfam | PF02985 | HEAT | IPR000357 | 404 | 441 |
| AT5G53480.1 | HMMPfam | PF02985 | HEAT | IPR000357 | 362 | 398 |
| AT5G53480.1 | HMMPfam | PF02985 | HEAT | IPR000357 | 214 | 250 |

Example 19

Topology Prediction of the iSYT Polypeptide Sequences

TargetP 1.1 predicts the subcellular location of eukaryotic proteins. The location assignment is based on the predicted presence of any of the N-terminal pre-sequences: chloroplast transit peptide (cTP), mitochondrial targeting peptide (mTP) or secretory pathway signal peptide (SP). Scores on which the final prediction is based are not really probabilities, and they do not necessarily add to one. However, the location with the highest score is the most likely according to TargetP, and the relationship between the scores (the reliability class) may be an indication of how certain the prediction is. The reliability class (RC) ranges from 1 to 5, where 1 indicates the strongest prediction. TargetP is maintained at the server of the Technical University of Denmark.

For the sequences predicted to contain an N-terminal pre-sequence a potential cleavage site can also be predicted.

A number of parameters is selected, such as organism group (non-plant or plant), cutoff sets (none, predefined set of cutoffs, or user-specified set of cutoffs), and the calculation of prediction of cleavage sites (yes or no).

Many other algorithms can be used to perform such analyses, including:
ChloroP 1.1 hosted on the server of the Technical University of Denmark;
Protein Prowler Subcellular Localisation Predictor version 1.2 hosted on the server of the Institute for Molecular Bioscience, University of Queensland, Brisbane, Australia;
PENCE Proteome Analyst PA-GOSUB 2.5 hosted on the server of the University of Alberta, Edmonton, Alberta, Canada;
TMHMM, hosted on the server of the Technical University of Denmark
PSORT (URL: psort.org)
PLOC (Park and Kanehisa, Bioinformatics, 19, 1656-1663, 2003).

Example 20

Cloning of the iSYT Encoding Nucleic Acid Sequence

The method was adapted from the Multisite Gateway® Pro (Invitrogen™).

Each plant transformation vector was constructed in two steps: First, the two coding sequences of gene of interest were amplified from the cDNA obtained from the appropriate source using a high-fidelity PCR. To this end primers were designed and synthesized using standard methods. Then the sequences were cloned in pDONR201P1-P4 and pDONR201 P3-P2 (Invitrogen™), respectively, using the Gateway™ BP (Invitrogen™) standard reaction method. The resulting clone was called the Entry Clone (EC), in accordance with Gateway method terminology. The other entry clone that carried a terminator and a promoter was produced by using pDONR201P4r-P3r. The identity of the clone was verified by restriction digestion analysis and complete sequencing of the insert. After verification, the clone (EC) went through a second Gateway method step which allows transfer of the inserts of all 3 ECs to the so-called Destination Vector (DV) using the Gateway LR (Invitrogen™) standard reaction method. On the destination vector, a promoter and a terminator designed for stacking genes were already in place. The identity of the resulting clone was verified by restriction digestion analysis and then by sequencing. After this verification, this binary vector was used as plant transformation vector. The plant transformation vector contains following functional cassettes in its t-DNA region: the selectable marker gene, the visual (reporter) marker gene, and two genes of interest. Each of these genes was driven by its corresponding promoter and terminator. The binary vector is then cloned into a disarmed *Agrobacterium tumefaciens* which is used to transform rice.

Example 21

Plant Transformation

Rice Transformation

The *Agrobacterium* containing the expression vector is used to transform *Oryza sativa* plants. Mature dry seeds of the rice japonica cultivar Nipponbare are dehusked. Sterilization is carried out by incubating for one minute in 70% ethanol, followed by 30 minutes in 0.2% $HgCl_2$, followed by a 6 times 15 minutes wash with sterile distilled water. The sterile seeds are then germinated on a medium containing 2,4-D (callus induction medium). After incubation in the dark for four weeks, embryogenic, scutellum-derived calli are excised and propagated on the same medium. After two weeks, the calli are multiplied or propagated by subculture on the same medium for another 2 weeks. Embryogenic callus pieces are sub-cultured on fresh medium 3 days before co-cultivation (to boost cell division activity).

*Agrobacterium* strain LBA4404 containing the expression vector is used for co-cultivation. *Agrobacterium* was inoculated on AB medium with the appropriate antibiotics and cultured for 3 days at 28° C. The bacteria are then collected and suspended in liquid co-cultivation medium to a density ($OD_{600}$) of about 1. The suspension is then transferred to a Petri dish and the calli immersed in the suspension for 15 minutes. The callus tissues are then blotted dry on a filter paper and transferred to solidified, co-cultivation medium and incubated for 3 days in the dark at 25° C. Co-cultivated calli are grown on 2,4-D-containing medium for 4 weeks in the dark at 28° C. in the presence of a selection agent. During this period, rapidly growing resistant callus islands developed. After transfer of this material to a regeneration medium and incubation in the light, the embryogenic potential is released and shoots developed in the next four to five weeks. Shoots are excised from the calli and incubated for 2 to 3 weeks on an auxin-containing medium from which they are transferred to soil. Hardened shoots era grown under high humidity and short days in a greenhouse.

Approximately 35 independent T0 rice transformants are generated for one construct. The primary transformants are transferred from a tissue culture chamber to a greenhouse. After a quantitative PCR analysis to verify copy number of the T-DNA insert, only single copy transgenic plants that exhibit tolerance to the selection agent are kept for harvest of T1 seed. Seeds are then harvested three to five months after transplanting. The method yielded single locus transformants at a rate of over 50% (Aldemita and Hodges 1996, Chan et al. 1993, Hiei et al. 1994).

Example 22

Transformation of Other Crops

Corn Transformation

Transformation of maize (*Zea mays*) is performed with a modification of the method described by Ishida et al. (1996) Nature Biotech 14(6): 745-50. Transformation is genotype-dependent in corn and only specific genotypes are amenable to transformation and regeneration. The inbred line A188 (University of Minnesota) or hybrids with A188 as a parent are good sources of donor material for transformation, but other genotypes can be used successfully as well. Ears are harvested from corn plant approximately 11 days after pollination (DAP) when the length of the immature embryo is about 1 to 1.2 mm. Immature embryos are cocultivated with *Agrobacterium tumefaciens* containing the expression vector, and transgenic plants are recovered through organogenesis. Excised embryos are grown on callus induction medium, then maize regeneration medium, containing the selection agent (for example imidazolinone but various selection markers can be used). The Petri plates are incubated in the light at 25° C. for 2-3 weeks, or until shoots develop. The green shoots are transferred from each embryo to maize rooting medium and incubated at 25° C. for 2-3 weeks, until roots develop. The rooted shoots are transplanted to soil in the greenhouse. T1 seeds are produced from plants that exhibit tolerance to the selection agent and that contain a single copy of the T-DNA insert.

Wheat Transformation

Transformation of wheat is performed with the method described by Ishida et al. (1996) Nature Biotech 14(6): 745-50. The cultivar Bobwhite (available from CIMMYT, Mexico) is commonly used in transformation. Immature embryos are co-cultivated with *Agrobacterium tumefaciens* containing the expression vector, and transgenic plants are recovered through organogenesis. After incubation with *Agrobacterium*, the embryos are grown in vitro on callus induction medium, then regeneration medium, containing the selection agent (for example imidazolinone but various selection markers can be used). The Petri plates are incubated in the light at 25° C. for 2-3 weeks, or until shoots develop. The green shoots are transferred from each embryo to rooting medium and incubated at 25° C. for 2-3 weeks, until roots develop. The rooted shoots are transplanted to soil in the greenhouse. T1 seeds are produced from plants that exhibit tolerance to the selection agent and that contain a single copy of the T-DNA insert.

Soybean Transformation

Soybean is transformed according to a modification of the method described in the Texas A&M U.S. Pat. No. 5,164,310. Several commercial soybean varieties are amenable to transformation by this method. The cultivar Jack (available from the Illinois Seed foundation) is commonly used for transformation. Soybean seeds are sterilised for in vitro sowing. The hypocotyl, the radicle and one cotyledon are excised from seven-day old young seedlings. The epicotyl and the remaining cotyledon are further grown to develop axillary nodes. These axillary nodes are excised and incubated with *Agrobacterium tumefaciens* containing the expression vector. After the cocultivation treatment, the explants are washed and transferred to selection media. Regenerated shoots are excised and placed on a shoot elongation medium. Shoots no longer than 1 cm are placed on rooting medium until roots develop. The rooted shoots are transplanted to soil in the greenhouse. T1 seeds are produced from plants that exhibit tolerance to the selection agent and that contain a single copy of the T-DNA insert.

Rapeseed/Canola Transformation

Cotyledonary petioles and hypocotyls of 5-6 day old young seedling are used as explants for tissue culture and transformed according to Babic et al. (1998, Plant Cell Rep 17: 183-188). The commercial cultivar Westar (Agriculture Canada) is the standard variety used for transformation, but other varieties can also be used. Canola seeds are surface-sterilized for in vitro sowing. The cotyledon petiole explants with the cotyledon attached are excised from the in vitro seedlings, and inoculated with Agrobacterium (containing the expression vector) by dipping the cut end of the petiole explant into the bacterial suspension. The explants are then cultured for 2 days on MSBAP-3 medium containing 3 mg/l BAP, 3% sucrose, 0.7 Phytagar at 23° C., 16 hr light. After two days of co-cultivation with Agrobacterium, the petiole explants are transferred to MSBAP-3 medium containing 3 mg/l BAP, cefotaxime, carbenicillin, or timentin (300 mg/l) for 7 days, and then cultured on MSBAP-3 medium with cefotaxime, carbenicillin, or timentin and selection agent until shoot regeneration. When the shoots are 5-10 mm in length, they are cut and transferred to shoot elongation medium (MSBAP-0.5, containing 0.5 mg/l BAP). Shoots of about 2 cm in length are transferred to the rooting medium (MS0) for root induction. The rooted shoots are transplanted to soil in the greenhouse. T1 seeds are produced from plants that exhibit tolerance to the selection agent and that contain a single copy of the T-DNA insert.

Alfalfa Transformation

A regenerating clone of alfalfa (Medicago sativa) is transformed using the method of (McKersie et al., 1999 Plant Physiol 119: 839-847). Regeneration and transformation of alfalfa is genotype dependent and therefore a regenerating plant is required. Methods to obtain regenerating plants have been described. For example, these can be selected from the cultivar Rangelander (Agriculture Canada) or any other commercial alfalfa variety as described by Brown DCW and A Atanassov (1985. Plant Cell Tissue Organ Culture 4: 111-112). Alternatively, the RA3 variety (University of Wisconsin) has been selected for use in tissue culture (Walker et al., 1978 Am J Bot 65:654-659). Petiole explants are cocultivated with an overnight culture of Agrobacterium tumefaciens C58C1 pMP90 (McKersie et al., 1999 Plant Physiol 119: 839-847) or LBA4404 containing the expression vector. The explants are cocultivated for 3 d in the dark on SH induction medium containing 288 mg/L Pro, 53 mg/L thioproline, 4.35 g/L K2SO4, and 100 μm acetosyringinone. The explants are washed in half-strength Murashige-Skoog medium (Murashige and Skoog, 1962) and plated on the same SH induction medium without acetosyringinone but with a suitable selection agent and suitable antibiotic to inhibit Agrobacterium growth. After several weeks, somatic embryos are transferred to BOi2Y development medium containing no growth regulators, no antibiotics, and 50 g/L sucrose. Somatic embryos are subsequently germinated on half-strength Murashige-Skoog medium. Rooted seedlings were transplanted into pots and grown in a greenhouse. T1 seeds are produced from plants that exhibit tolerance to the selection agent and that contain a single copy of the T-DNA insert.

Cotton Transformation

Cotton is transformed using Agrobacterium tumefaciens according to the method described in U.S. Pat. No. 5,159,135. Cotton seeds are surface sterilised in 3% sodium hypochlorite solution during 20 minutes and washed in distilled water with 500 μg/ml cefotaxime. The seeds are then transferred to SH-medium with 50 μg/ml benomyl for germination. Hypocotyls of 4 to 6 days old seedlings are removed, cut into 0.5 cm pieces and are placed on 0.8% agar. An Agrobacterium suspension (approx. 108 cells per ml, diluted from an overnight culture transformed with the gene of interest and suitable selection markers) is used for inoculation of the hypocotyl explants. After 3 days at room temperature and lighting, the tissues are transferred to a solid medium (1.6 g/l Gelrite) with Murashige and Skoog salts with B5 vitamins (Gamborg et al., Exp. Cell Res. 50:151-158 (1968)), 0.1 mg/l 2,4-D, 0.1 mg/l 6-furfurylaminopurine and 750 μg/ml MgCL2, and with 50 to 100 μg/ml cefotaxime and 400-500 μg/ml carbenicillin to kill residual bacteria. Individual cell lines are isolated after two to three months (with subcultures every four to six weeks) and are further cultivated on selective medium for tissue amplification (30° C., 16 hr photoperiod). Transformed tissues are subsequently further cultivated on non-selective medium during 2 to 3 months to give rise to somatic embryos. Healthy looking embryos of at least 4 mm length are transferred to tubes with SH medium in fine vermiculite, supplemented with 0.1 mg/l indole acetic acid, 6 furfurylaminopurine and gibberellic acid. The embryos are cultivated at 30° C. with a photoperiod of 16 hrs, and plantlets at the 2 to 3 leaf stage are transferred to pots with vermiculite and nutrients. The plants are hardened and subsequently moved to the greenhouse for further cultivation.

Example 23

Phenotypic Evaluation Procedure 23.1 Evaluation Setup

Approximately 35 independent T0 rice transformants are generated. The primary transformants are transferred from a tissue culture chamber to a greenhouse for growing and harvest of T1 seed. Events, of which the T1 progeny segregated 3:1 for presence/absence of the transgene, are retained. For each of these events, approximately 10 T1 seedlings containing the transgene (hetero- and homo-zygotes) and approximately 10 T1 seedlings lacking the transgene (nullizygotes) are selected by monitoring visual marker expression. The transgenic plants and the corresponding nullizygotes are grown side-by-side at random positions. Greenhouse conditions are of shorts days (12 hours light), 28° C. in the light and 22° C. in the dark, and a relative humidity of 70%. Plants grown under non-stress conditions are watered at regular intervals to ensure that water and nutrients are not limiting and to satisfy plant needs to complete growth and development.

T1 events are further evaluated in the T2 generation following the same evaluation procedure as for the T1 generation but with more individuals per event. From the stage of sowing until the stage of maturity the plants are passed several times through a digital imaging cabinet. At each time point digital images (2048×1536 pixels, 16 million colours) are taken of each plant from at least 6 different angles.

Drought Screen

Plants from T2 seeds are grown in potting soil under normal conditions until they approached the heading stage. They are then transferred to a "dry" section where irrigation is withheld. Humidity probes are inserted in randomly chosen pots to monitor the soil water content (SWC). When SWC goes below certain thresholds, the plants are automatically re-watered continuously until a normal level is reached again. The plants are then re-transferred again to normal conditions. The rest of the cultivation (plant maturation, seed harvest) is the same as for plants not grown under abiotic stress conditions. Growth and yield parameters are recorded as detailed for growth under normal conditions.

Nitrogen Use Efficiency Screen

Rice plants from T2 seeds are grown in potting soil under normal conditions except for the nutrient solution. The pots are watered from transplantation to maturation with a specific nutrient solution containing reduced N nitrogen (N) content, usually between 7 to 8 times less. The rest of the cultivation (plant maturation, seed harvest) is the same as for plants not grown under abiotic stress. Growth and yield parameters are recorded as detailed for growth under normal conditions.

Salt Stress Screen

Plants are grown on a substrate made of coco fibers and argex (3 to 1 ratio). A normal nutrient solution is used during the first two weeks after transplanting the plantlets in the greenhouse. After the first two weeks, 25 mM of salt (NaCl) is added to the nutrient solution, until the plants are harvested. Seed-related parameters are then measured.

23.2 Statistical Analysis: F Test

A two factor ANOVA (analysis of variants) is used as a statistical model for the overall evaluation of plant phenotypic characteristics. An F test is carried out on all the parameters measured of all the plants of all the events transformed with the gene of the present invention. The F test is carried out to check for an effect of the gene over all the transformation events and to verify for an overall effect of the gene, also known as a global gene effect. The threshold for significance for a true global gene effect is set at a 5% probability level for the F test. A significant F test value points to a gene effect, meaning that it is not only the mere presence or position of the gene that is causing the differences in phenotype.

23.3 Parameters Measured

Biomass-Related Parameter Measurement

From the stage of sowing until the stage of maturity the plants are passed several times through a digital imaging cabinet. At each time point digital images (2048×1536 pixels, 16 million colours) are taken of each plant from at least 6 different angles.

The plant aboveground area (or leafy biomass) is determined by counting the total number of pixels on the digital images from aboveground plant parts discriminated from the background. This value is averaged for the pictures taken on the same time point from the different angles and was converted to a physical surface value expressed in square mm by calibration. Experiments show that the aboveground plant area measured this way correlates with the biomass of plant parts above ground. The above ground area is the area measured at the time point at which the plant had reached its maximal leafy biomass. The early vigour is the plant (seedling) aboveground area three weeks post-germination. Increase in root biomass is expressed as an increase in total root biomass (measured as maximum biomass of roots observed during the lifespan of a plant); or as an increase in the root/shoot index (measured as the ratio between root mass and shoot mass in the period of active growth of root and shoot).

Early vigour is determined by counting the total number of pixels from aboveground plant parts discriminated from the background. This value was averaged for the pictures taken on the same time point from different angles and was converted to a physical surface value expressed in square mm by calibration. The results described below are for plants three weeks post-germination.

Seed-Related Parameter Measurements

The mature primary panicles are harvested, counted, bagged, barcode-labelled and then dried for three days in an oven at 37° C. The panicles are then threshed and all the seeds are collected and counted. The filled husks are separated from the empty ones using an air-blowing device. The empty husks are discarded and the remaining fraction was counted again. The filled husks were weighed on an analytical balance. The number of filled seeds is determined by counting the number of filled husks that remained after the separation step. The total seed yield is measured by weighing all filled husks harvested from a plant. Total seed number per plant is measured by counting the number of husks harvested from a plant. Thousand Kernel Weight (TKW) is extrapolated from the number of filled seeds counted and their total weight. The Harvest Index (HI) in the present invention is defined as the ratio between the total seed yield and the above ground area ($mm^2$), multiplied by a factor $10^6$. The total number of flowers per panicle as defined in the present invention is the ratio between the total number of seeds and the number of mature primary panicles. The seed fill rate as defined in the present invention is the proportion (expressed as a %) of the number of filled seeds over the total number of seeds (or florets).

Examples 24

Results of the Phenotypic Evaluation of the Transgenic Plants

Transgenic rice plants expressing a nucleic acid comprising the Open Reading Frame of at least two genes encoding an iSYT polypeptide are evaluated under one or more of the conditions abovementioned (non-stress conditions, drought stress, Nitrogene deficiency). The performance of the transgenic plants outperform the control plants in one or more yield-related traits selected from aboveground biomass (AreaMax), root biomass (RootMax and RootThickMax), and for seed yield (total weight of seeds, number of filled seeds, fill rate, harvest index) and thousand kernel weight. In addition, plants expressing In addition, the transgenic plants comprising recombinant nucleic acids expressing at least two iSYT polypeptides or homologues thereof or fusions of the same show a faster growth rate (a shorter time (in days) needed between sowing and the day the plant reaches 90% of its final biomass (AreaCycle) and an earlier start of flowering (TimetoFlower: time (in days) between sowing and the emergence of the first panicle).

SEQUENCE LISTING (672 sequences)

SEQ ID NO: 1 - DNA, 1166 bp, Arabidopsis thaliana
  misc_feature (386)..(386): r can be a or g
  misc_feature (425)..(425): y can be t or c
aacgcaaaacaacttttgtggaggagagaaagcgagataacacacacacagagatacacatcttcaatagttaagagttttctatatacagaagcatagaggaaagagagagagacagatacaaaagttaatatctctctctctcacttggtgagacttctctttttcctctgggttttgtggtgggggttgtctctataaaaacttatatatataaaatatataaataaataagaaggaattatcaggttttatataaaatagcaaaagaaatgcaacagcacctgatgcagatgcagcccatgatggctggttactaccccagcaatgttacctctgatcatatccaacagtacttggacgaaaacaaatcgttgattctgaarattgttgagtctcaaaactctggaaagcttagcgaatgygccgagaatcaagcaaggcttcaacgcaacctaatgtacctagctgcaatagcagattctcagcctcagccaccaagtgtgcatagccagtatggatctgctggtggtgggatgattcagggagaaggagggtcacactatttgcagcagcaacaagcgactcaacagcaacagatgactcagcagtctctaatggcggctcgatcttcaatgttgtatgctcagcaacagcagcagcagcagccttacgcgacgcttcagcatcagcaattgcaccatagccagcttggaatgagctcgagcagcggaggaggaggaagcagtggtctccatatccttcagggagaggctggtgggtttcatgattttggccgtgggaagccggaaatgggaagtggtggtggcggtgaaggcagaggaggaagttcaggggatggtggagaaaccctttacttgaaatcatcagatgatgggaattgaaagagtgtggcacaaggaatcttaatgatgaagcagcagcagcagcagaagaagtagtagtaataataggagtcttgaagttagtgtgttttggttttagttgcttgttgaagaagcaaagaactctttatttacttctttttagttttgttattctctctatgtttgttccctaaaacagtgaacctctttcgtggtagtgtaccatgtaaatctgctggctccaagttgtgtcgtaatcttaatatgttatttctctga

SEQ ID NO: 2 - protein, 210 aa, Arabidopsis thaliana
  MISC_FEATURE (129)..(129): Xaa is Gln or Arg
  MISC_FEATURE (142)..(142): Xaa is Leu or Ser
MQQHLMQMQPMMAGYYPSNVTSDHIQQYLDENKSLILKIVESQNSGKLSECAENQARLQRNLMYLAAIADSQPQPPSVHSQYGSAGGGMIQGEGGSHYLQQQQATQQQQMTQQSLMAARSSMLYAQQQXQQQPYATLQHQQXHHSQLGMSSSSGGGGSSGLHILQGEAGGFHDFGRGKPEMGSGGGGEGRGGSSGDGGETLYLKSSDDGN

SEQ ID NO: 3 - DNA, 1546 bp, Arabidopsis thaliana
atgggaaagaaagagcagaaggatcatcattcagtagtagagagcgacgacaaagtcgaagctgttcttcatctccttcgtaaacattctcctctaactcttaaacaggagaagttctgtaacagagcttgtgtcggtagattcttgagaataaaaggagacaatgtgaagaaagcagctaaacagttaaggtcttgcctttcatggagatcttctcttggcattgagagtttgatcgccgatgagttcacggcggagcttgctgaaggtcttgcctacgtcgctggtcttgacgacgagtgtagacccgttttggttttccgcattaaacaagattatcagaagctacatacgcagaaacagttgacacgtttggtggtatttacattagaggttgctatctcaaccatgtccagaaacgtcgaacaatttgtcatccttttcgatgctattgcagcagcagtacttctcgtaactctgatagtactctttagcttttcattaaatgttcctcttttgatcctctgcaattccactgcacaccttcctttttttttctttttttttatttataaaacaaacccaaagcttcttcaaatcagcatcagctttcatgaacatacttgtgactacactcaaaatagtcgcagaggtattcgcacattcgtggatctatcaacggctacgatgattgtatcaatgcaagattttcaagactcgtttgactacgacgatttctcgtcatcatacccatcacgagtctcctccctacgattcgacacgtcatcactaaaatcaacggacaagatcggctcatgcgcatcctctaggttcgctttcaccgtatctcgcgacggactcgacacagtcaaaccatggtgtctcacgttgactgacacgtcatcaaccaaactaggacacaacacaggcgcgtacatctcaccgcttaacgcgcgttctttctctttcgcgtcaccggcggctagaagcgagccattcggtggtccaaggaggagcttcttcgcttccactccgatgccagctaggaccaccgaccgtcactctatcggaaccctacgggacccgcggatacctcgcccgtctttcttccaatctccggcgattttcttccggcgagagtcacacgtcagcaaaagtgagaaaccacgagattcgttcgttcagtttctcaagttttatcgtagaccgtacgatgagatgacttataggtcaaagatgaggccaccgctcggtggtcttgtatccattgtttcaactcagattagacgccgtcacgtgtctttatcccaacggttctaactcaaaaactatccacctattaaagtagtatataacttttgccgtgttttttttttttttaacttattgcaatgtttctatcatttttagttcgtcaagtgtatttttctaataattttgattaattgtttatttatcaagcatttttatatggttttgatttcaattatttatctaaattgttcaaagtgaaagtcgtaccgtttgaagtttgaatgctttgtat

SEQ ID NO: 4 - protein, 439 aa, Arabidopsis thaliana
MGKKEQKDHHSVVESDDKVEAVLHLLRKHSPLTLKQEKFCNRACVGRFLRIKGDNVKKAAKQLRSCLSWRSSLGIESLIADEFTAELAEGLAYVAGLDDECRPVLVFRIKQDYQKLHTQKQLTRLVVFTLEVAISTMSRNVEQFVILFDAIAAAVLLVTLIVLFSFSLNVPLLILCNSTAHLPFFFFFFIYKTNPKLLQISISFHEHTCDYTQNSRRGIRTFVDLSTATMIVSMQDFQDSFDYDDFSSSYPSRVSSLRFDTSSLKSTDKIGSCASSRFAFTVSRDGLDTVKPWCLTLTDTSSTKLGHNTGAYISPLNARSFSFASPAARSEPFGGPRRSFFASTPMPARTTDRHSIGTLRDPRIPRPSFFQSPAIFFRRESHVSKSEKPRDSFVQFLKFYRRPYDEMTYRSKMRPPLGGLVSIVSTQIRRRHVSLSQRF

SEQ ID NO: 5 - DNA, 4739 bp, Arabidopsis thaliana
atggtacgtgaatgttttactttccttaacatctttgtgttacatagcataggttctcatgtttggtttgaagaccctgaagtggcttggattgatggtgaggttgaaaaaatcaatggacaagaagttgtcatccaagccactactggaaaaaaggtcactgcaaagttgtcaaagatttaccctaaggatgtggaagctcctgctggtggtgttgatgacatgacaaaactctcttacttgcatgaacctggtgttcttcagaacttgaagatcagatatgaacttaatgagatctatacatacacaggaaacatccttattgcgattaatccgtttcaacgattgcctcacatctatgatgcccatatgatgcaacaatacaaaggagcaccattgggagaactaagtcctcatgtttttgctgttgctgatgttgcatacagggccatgattaatgagggaaaaagcaattcaattcttgtaagtggtgagagcggagctggaaaaactgaaaccactaagatgcttatgagatatcttgcatacttgggaggtcgtgctgttacagaaggacggactgttgaacaacaagttcttgaatcaaatcccgtccttgaagcctttgggaacgcaaaaactgtgaggaataacaattcaagtcgcttcggtaaatttgttgaaatccaatttgataagcaaggaagaatatctggagctgctatacggacctatcttctagagaggtctcgtgtgtgtcaaatctctgatcccgaacgaaattaccattgcttctatcttctttgtgccgcaccgcaggaggaaattgaaaagtacaagctcggtcatccaaagacttttcattatctgaaccagtccaagtgcttcgagcttgttggtataagcgatgctcatgattatcttgcgacaagaagagctatggatattgttggaattagcgaaaaggaacaggaagcaattttcagggtggttgcagcaattcttcacattggaaacatcgattttactaagggaaaggaagtggattcatcagttcccaaggatgagaagtcgaaatttcatcttaaaacagcagcagaacttctcatgtgtgatttaaaggcacttgaagatgcattatgtaaacgagttatgatcacacccgaggaagttatcaagagaagtcttgatccacagagtgctgtaaccagcagagacggtctcgctaagacagtctattctcgattgttcgattggttggtagacaagattaataagtcgattggacaagatgccaattctagatctctaattggagttctggacatttacggatttgagagcttcaaaactaacagttttgaacagttctgtattaatttcactaatgagaagttgcagcaacattttaatcagcacgttttcaagatggaacaggaagagtacacaaaagaagcaatagattggagttacattgaatttgtggacaatcaagatgttctcgatctcatagaaaagaagcctggtggaattgttgctctcctcgatgaagcttgcatgtttccaaagtcaacccacgaaacatttgcaaataagctgtatcagacttttaagacacacaagcggttcatcaaaccaaaactctctcgaacagatttcgctgttgcccattatgctggagaagttctatatcagtctgaactatttctggataaaaacaaggattatgtgatccctgaacaccaagatttgttgggggcttccaaatgtccctttgttgtgggtcttttccctccactcccagaagaaacatctaaatcgtcaaagttttcatccattggttctcgctttaagctgcaactccagcaactgatggaaacattaaattgcaccgagcctcattacatcagatgtgtgaagcctaacaatcttctaaagcctgccatatttgagaatgtgaacatcatgcagcaactgcgatgtggtggtgttttagaggcgatcagaattagttgtgcagggtatccaactcgtaaacctttctttgagttcataaaccgttttggacttctatctcctgctgctttagaagggaacttcgatgagaaagtcgcatgtcaaaagatcttggataacatgggactcaaaggataccagattggtaaaacaaaggtcttcttgagggctggtcagatggctgaactcgacgctagaagggctgaggttctaagtagtgctgcaaaaaaaattcagcgacgtatacgtactcatcaagctcagaaacggttcattgttctgagaaaagccaccatttctcttcaagctatatgtagaggaagactttcctgcaaacattacgataatttgagacgagaagctgctgctgtgaagattcagaagaatggtcggagacattattctagaaaatcatataaaaaactccatgtagcttctcttgttgtacagactggtttaagagcaatggctgctcgtaaacaattcagattcaggaagcaaacaaaggctgccacaattgttcaggctcagtggcgttgtcacagagcaatctcgtactacaaaaagcttaaaaatggagtggtcctatctcagacacgatggagaggcagacttgctaagagagaacttaggaagctcaaaatggctgcaagggaaacaggagcacttaaagaggcaaaggatatgcttgaaaagaaagtcgaggaactcacataccgtgtccagttggagaaacgttcgaggggtgacttagaagaagcaaagactcaggagattttgaaacttaagagttcattcgaagaaatgcggaagaaagttgatgaaacaaatgcgttgcttctgaaggaacgtgaagctgcaaagaaagccgctgaagaagctcctcctgttatcaaagaaacacaaattttagttgaagataccaagaagattgaattgatgacggaggaactggagagtgtaaaggttactctagagaacgaaaaacaaagggctgatgatgcagtgaggaaattcgaagaagctcaagagtctctcgaagacaaaaagaaaaaactggaagagacagagaagaaaggtcagcaactccaagaatcactgacaaggatggaagaaaagtgcagcaacttggaatcagagaataaagtcctacggcagcaggctgtgtccatggcaccgaataaatttctctctggccgctcccggtccattttacagagaggttcagagagtggtcatcttgcagtggatgcgaggtcaaacttggatctgcatagccattcgattaaccatagagatccctcagaagtggaggataaaccacagaaatcattaaatgagaagcagcaagaaaatcaagacctacttatccgctccattgttcaacacttgggattccaggggaaccgacctatcacagcatgtatcatttacaaatgtttactgcaatggaggtcatttgaagttgaacgaaccagtgtctttgatcgcattattcagacaataggccatgctattgagactcaagataacaacaatacattggcctattggttatccaatacctcgacactcctattactcctccagcgcacactcaaagctagtggtgcagctgggatggctccgcagcgccgccgttcatcttctgccactctatttggaaggatgagtcagagcttccgcggggcacccccaggtgtaaatcttgccatgataaacggtgctgcgggaggtggagcagatacctttagacaagttgaagcaaaatatccggctctactgtttaagcagcagctcacagcttatgttgaaaagatatacggaatgattcgcgataacttgaagaaggagatttctccactccttggattgtgcattcaggcaccaagaacatcgagggctagtttagtgaaaggagcatctcgttccgttggcaacactgcagctcagcaggcactgatcgcccattggcaaggaattgtcaagagtcttacaaatttcctcaatactctaaaatcaaacaatgttccttcatttttggtgcgtaaggtgtttacgcagatattctcattcatcaatgttcagctgtttaacagccttttattgagacgcgagtgttgttcatttagtaatggggagtacgtcaaagcgggcttgtctgaattggaacactggtgttttaaggccacaaatgagtatgcgggttcttcgtgggatgagcttaagcatattagacaggccattgggtttctggttgtacatcaaaaaccaaagaaaactcttgatgagatcagtcatgatctttgcccggtactaagcatacaacagttatacagaatcagtaccatgtactgggacgacaaatacggcacccatagcgtctctccagacgtaatagcaaatatgagggtgctaatgacagaagattcgaacaatgctgttagcaactcattccttttggatgacgactcgagcatccctttctcggttgatgatttatcaaagtcgatggagaaatttgaaatagcggatatcgaaccgccacctttaatccgggagaattctggatttagcttcttattgccagtctctgagtgattcttttttgtctctacaatacacacacaccaacggaagccatatattctttttgaagtgttcctcacttattcttttaaatgttcatgacttattctttcgggttaatttactgaatgacc

SEQ ID NO: 6 - protein, 1538 aa, Arabidopsis thaliana
MVRECFTFLNIFVLHSIGSHVWFEDPEVAWIDGEVEKINGQEVVIQATTGKKVTAKLSKIYPKDVEAPAGGVDDMTKLSYLHEPGVLQNLKIRYELNEIYTYTGNILIAINPFQRLPHIYDAHMMQQYKGAPLGELSPHVFAVADVAYRAMINEGKSNSILVSGESGAGKTETTKMLMRYLAYLGGRAVTEGRTVEQQVLESNPVLEAFGNAKTVRNNNSSRFGKFVEIQFDKQGRISGAAIRTYLLERSRVCQISDPERNYHCFYLLCAAPQEEIEKYKLGHPKTFHYLNQSKCFELVGISDAHDYLATRRAMDIVGISEKEQEAIFRVVAAILHIGNIDFTKGKEVDSSVPKDEKSKFHLKTAAELLMCDLKALEDALCKRVMITPEEVIKRSLDPQSAVTSRDGLAKTVYSRLFDWLVDKINKSIGQDANSRSLIGVLDIYGFESFKTNSFEQFCINFTNEKLQQHFNQHVFKMEQEEYTKEAIDWSYIEFVDNQDVLDLIEKKPGGIVALLDEACMFPKSTHETFANKLYQTFKTHKRFIKPKLSRTDFAVAHYAGEVLYQSELFLDKNKDYVIPEHQDLLGASKCPFVVGLFPPLPEETSKSSKFSSIGSRFKLQLQQLMETLNCTEPHYIRCVKPNNLLKPAIFENVNIMQQLRCGGVLEAIRISCAGYPTRKPFFEFINRFGLLSPAALEGNFDEKVACQKILDNMGLKGYQIGKTKVFLRAGQMAELDARRAEVLSSAAKKIQRRIRTHQAQKRFIVLRKATISLQAICRGRLSCKHYDNLRREAAAVKIQKNGRRHYSRKSYKKLHVASLVVQTGLRAMAARKQFRFRKQTKAATIVQAQWRCHRAISYYKKLKNGVVLSQTRWRGRLAKRELRKLKMAARETGALKEAKDMLEKKVEELTYRVQLEKRSRGDLEEAKTQEILKLKSSFEEMRKKVDETNALLLKEREAAKKAAEEAPPVIKETQILVEDTKKIELMTEELESVKVTLENEKQRADDAVRKFEEAQESLEDKKKKLEETEKKGQQLQESLTRMEEKCSNLESENKVLRQQAVSMAPNKFLSGRSRSILQRGSESGHLAVDARSNLDLHSHSINHRDPSEVEDKPQKSLNEKQQENQDLLIRSIVQHLGFQGNRPITACIIYKCLLQWRSFEVERTSVFDRIIQTIGHAIETQDNNNTLAYWLSNTSTLLLLLQRTLKASGAAGMAPQRRRSSSATLFGRMSQSFRGAPPGVNLAMINGAAGGGADTFRQVEAKYPALLFKQQLTAYVEKIYGMIRDNLKKEISPLLGLCIQAPRTSRASLVKGASRSVGNTAAQQALIAHWQGIVKSLTNFLNTLKSNNVPSFLVRKVFTQIFSFINVQLFNSLLLRRECCSFSNGEYVKAGLSELEHWCFKATNEYAGSSWDELKHIRQAIGFLVVHQKPKKTLDEISHDLCPVLSIQQLYRISTMYWDDKYGTHSVSPDVIANMRVLMTEDSNNAVSNSFLLDDDSSIPFSVDDLSKSMEKFEIADIEPPPLIRENSGFSFLLPVSE

SEQ ID NO: 7 - DNA, 2062 bp, Arabidopsis thaliana
agcaccagacgactcgtcctccacgatcccaatttctccaatttcaattttgccaaagagcgagagagaaggaagaagatccagacgaagtggtttgccttcagggaacgagagagagaaagagattttaacaaacgatgtcgctgaggccgagcacacgcgcggagctaaggaagaagatatacaagacaggcgtcgatgccgatgaggccaggcggaggagagaggacaatctcgtcgagattaggaaaaacaagcgtgaggatagtcttctcaagaagcgtcgtgaaggaatgatgcttcagcagcagctgcctctcggagctggccttgatggtccccagaccgctgccgccgttgagaaacgattagaaggtatcccaatgatggtacaaggtgtttattctgatgatcctcaagctcagctagaagcgactacccaatttagaaagttgttatctatagagcgtagtcctccaattgatgaagtgatcaaagctggggttatccctcgatttgtggagtttcttggaaggcatgaccatcctcaattgcagtttgaggctgcatgggctttgaccaatgttgcgtcaggaacatcagatcatactcgggttgtaatcgaacagggggcggttcctatcttcgttaagcttcttacatctgctagtgatgacgttcgagagcaggcggtgtgggccttgggaaatgttgctggggactctccaaactgcaggaatcttgttctcaactatggggcccttgagccattgctggctcagttaaatgaaaattctaagttgtccatgctaagaaatgctacatggaccttgtccaacttttgtcgtggtaaaccaccaacaccatttgaacaggtgaagcctgcgttgccaattcttcggcagcttatctatctgaatgatgaagaggttctcactgatgcttgctgggctctctcctacctttcagatggccccaatgataagattcaggctgtgattgaggcaggtgtctgtccacgacttgtggagcttttgggtcatcaatcacctacggttctcattcctgctcttcgaactgttgggaacatcgtaactggtgatgactctcagacacagtttataattgagagtggcgtactaccacacctttataatttgctgacgcaaaatcacaagaaaagtataaaaaaagaagcttgttggactatctcgaatattactgctgggaataaacttcagatagaggctgtggttggcgctggaataatcctccctcttgtgcacttgctccaaaacgcggagttcgatataaagaaggaagctgcttgggctatttccaatgccacatcaggagggtcacatgagcagattcaatatttggtgacccaaggctgcatcaaaccactttgtgatcttctaatctgccctgatccaaggatcgtgacagtgtgcctcgagggtcttgaaaacattctcaaggttggtgaggctgacaaggaaatgggattaaacagtggggtgaatctctatgctcaaataatagaagaatctgatgggttggacaaagtcgaaaaccttcaatcccatgataacaacgagatatatgagaaggccgttaagatattggagagatattgggctgaagaagaggaagaacagattctgcaggacggcgggaatgacaattcacaacaggctttcaattttgggaacaatcccgctgctcccgttggtggattcaaatttgcctgaaaaaggttcaagttcgactttttgagttctggtgcaaaaaggcttatttttctgtttttttttctttttgttgttgatgttgtccttatttgtctgaatcattctctgattctgtatcttaaactctgctatgaattatgtgtagtgtggtttctggtttaggatatggtacactttgtatttgtcactttaatctttgtcgtcgttatagtttaataacttttacttggcaagagtacaagtacaagaaatatttgattgcaaaagagtcttcttgtcttgttaataaagtcctcaaatgaattggt

SEQ ID NO: 8 - protein, 538 aa, Arabidopsis thaliana
MSLRPSTRAELRKKIYKTGVDADEARRRREDNLVEIRKNKREDSLLKKRREGMMLQQQLPLGAGLDGPQTAAAVEKRLEGIPMMVQGVYSDDPQAQLEATTQFRKLLSIERSPPIDEVIKAGVIPRFVEFLGRHDHPQLQFEAAWALTNVASGTSDHTRVVIEQGAVPIFVKLLTSASDDVREQAVWALGNVAGDSPNCRNLVLNYGALEPLLAQLNENSKLSMLRNATWTLSNFCRGKPPTPFEQVKPALPILRQLIYLNDEEVLTDACWALSYLSDGPNDKIQAVIEAGVCPRLVELLGHQSPTVLIPALRTVGNIVTGDDSQTQFIIESGVLPHLYNLLTQNHKKSIKKEACWTISNITAGNKLQIEAVVGAGIILPLVHLLQNAEFDIKKEAAWAISNATSGGSHEQIQYLVTQGCIKPLCDLLICPDPRIVTVCLEGLENILKVGEADKEMGLNSGVNLYAQIIEESDGLDKVENLQSHDNNEIYEKAVKILERYWAEEEEEQILQDGGNDNSQQAFNFGNNPAAPVGGFKFA

SEQ ID NO: 9 - DNA, 1627 bp, Arabidopsis thaliana
ccgagattacagagaaccccgtcccgtgtttaaaccctccggcgacaaagctcagatagagaaccgctccacccttgtcgttcgctgcagccatgtacggcggagatgaagtgtcagctattgtggttgacttgggttcgcacacttgcaaggctggttacgccggtgaagatgctcccaaggccgttttcccttccgttattggggcagtagatggtgtagaggcaatggatgtggatgttgattctacaaagactaattcgaactctgaggattcgaagaccgagtctgaaaaggaaaagagcaaacgcaagctctatgtaggatctcaagccatgagctaccgcagagatcatatggaggttttgtcacctataaaagatggcatcgtttctgactgggatttggtggacaatatatgggaacatgctttcaagagttgtctgatgattgatcctacggagcatccaatgctgctagctgagcctcctttaaacactcaacagcagagagagaaggcggcagagctaatgtttgaaaagtacaaagttccggcactgtttatggctaagaaccctgttctcacgtcttttgctactgggcgtgctacttctttggttgttgactgcggtggaggatccacaaccatttcaccggtgcatgatggttatgttcttcagaaggctgttgtatcgtctccacttggaggggaatttctcactgactgcctactgaaaagcttggagagtaaaggaattaaaataagacctagatactctttcaagaggaaggaagtacgagcaggggaattccaggttgaagatgtggatattcctgacaccacggaaagctacaaactcttctgccagaggatgatagtgggtgatatcaaggattccatttgtcgagttcctgatactccctatgacgataaatcatattcaaacatccctactacgtcgtacgagcttcctgatggccagacgctcgagattggtgctgataggttcaaagttcctgatgtgatgttcaacccgtccatagtccagacgattcctggaatggagaagtatgctgagatgattccttccgttcgtgggttaccacacatggtcatggagagcatcaacaaatgtgatgtagacatccggagagagttgtatagtagcatactgcttgctggtggcacatcgtcaatgcaacagctgaaagaacgtctcgaaaaggacttgatcgaagagtctcctcactcagctagagttaaagtgttggcaagcggtaacacaacagaaagaagattcagtgtatggataggagggagtatattggcatcactaggctcatttcaacagatgtggttctccaagtctgagtatgaggaacatggagcttcctacattcagagaaaatgcccttaaagcaggcagtttcagattatgtggagtctgacaagacgaaacttggaaactaatgtgttattttcattgtgcatcgttgttccttgaagattattagtattccgcctgaaccttttagaatgagtgtcattaacaagcattatagtgctattttaaaaacataaaaacatgtggaagaagtttcgttgctttattagattttcgcacaa

SEQ ID NO: 10 - protein, 441 aa, Arabidopsis thaliana
MYGGDEVSAIVVDLGSHTCKAGYAGEDAPKAVFPSVIGAVDGVEAMDVDVDSTKTNSNSEDSKTESEKEKSKRKLYVGSQAMSYRRDHMEVLSPIKDGIVSDWDLVDNIWEHAFKSCLMIDPTEHPMLLAEPPLNTQQQREKAAELMFEKYKVPALFMAKNPVLTSFATGRATSLVVDCGGGSTTISPVHDGYVLQKAVVSSPLGGEFLTDCLLKSLESKGIKIRPRYSFKRKEVRAGEFQVEDVDIPDTTESYKLFCQRMIVGDIKDSICRVPDTPYDDKSYSNIPTTSYELPDGQTLEIGADRFKVPDVMFNPSIVQTIPGMEKYAEMIPSVRGLPHMVMESINKCDVDIRRELYSSILLAGGTSSMQQLKERLEKDLIEESPHSARVKVLASGNTTERRFSVWIGGSILASLGSFQQMWFSKSEYEEHGASYIQRKCP

SEQ ID NO: 11 - DNA, 2394 bp, Arabidopsis thaliana
aggaggagaaagagaaagggggaagagaggagagagagagagagaaagagattagagagagaaagaagagaagaggagagagaaaaaaatgggtgaggtagcagatacaatgacgaagaagaagaagaaaggaaggccatctctattagaccttcaaaaacgagctatcaaacaacaacaacaacaattacaacagcaacaacaacaacacaagaacaaccatcaagacgacgatgaccaccaccacaacaacaacaatagatccggctcgaaaaaccctaattctctcaatcaccgatccaaacgccggaaccctaattcaaacgacggcgattccccttggatcaaagacgaaggtgaagacaacgacgatgacgagcggcgagagaagaaacataagcttttacatggattgaactctcactctcatcgacattctcctaattctcaatccgatctgaatctcgaccaaactccagaaccgtcctttaatagacgcaacctctccgccgccgcctccggatctgattatcatacgggagaaaaggcttcgaaagcgacagacattcttcaagggtctcccgtggagtctggtcccactactcctttgccagacaaaaagttgttactcttcatcctcgatagacttcaaaagaaggatacttatggagtttactctgacccggttgatcctgaggagcttcctgattattttgagattattaagaatccaatggattttagcacattgcggaacaaattagactctggagcatattccactttagaacaatttgagagagatgtgtttttaatatgtacaaatgcaatggaatacaattcagcagacactgtatattatcgacaggcacgggctatacaagagttggcaaaaaaggattttgagaatttaaggcaagacagtgatgatgaagaaccacaaagccaacaacagcaacagcagcaaccaaaagttgcaagaagaggccgtccgccaaagaaacatcctgaaccatcttctattgaccgcactgcttctgaaatttcagctgatgctctcattcctggagatagctctaacaagttttctggtgcttacaatttaagaaaggctcctccttcatacaaattccgccaagcagaatcatcagttagaatcaatcataacagtgaaacccagagtggttggtcggtagactgggagagcgaatttccatcttcggttgtgaaggcggttaacaagtatgggatgaaacatttcaatgtcgatgataacagacgcgatacctacaaccacctctcgacttctacccaagaaccatcggttttgacaacgcttgaagacgagttaaaacagttgattccagttgggctgaacatggagtacggttacgcgaagagtctagcacgatatgctgcaaatcttggtcctgttgcctggaaaattgcatcgaggagaatcgagactgtattgccctctggaatcaaatttggtcaaggttgggttggagagaacccagcaggacctgaagaggatgattctcagaaacaaaacatattaatgtcgtcgggaaaacaaaagtgttctaatgacttagcgtctgatgatcattctaacagaatcctgtctccaaccgcttcagtttcaagtgctttcataggaaacagacatgcttcctctcaagccatcgaagagaccacaccaccacctgctcgtgtcttgaatccagaaatcgatcacccatcctcctcctctcaccaagcaggactgctaatcaaaacagagagcagcaacggcctcatccgcggattcaaccataatgcaaatcagatgctcggaattgctagacagcaacaaccaaacgtaagcaacgaggccacaccggtctcgcaacaacaaggctcattgtttccttaccccaaacaagaattccaccggtttccgccagaccttaacgctaggctagtctcaccaaactccccgggctctaatcagcagactggttcgtcctcgtcgcagcatccggatctggcattacagctgtgaagatgagtattggatatttgaaagaggaagaagaggcattttccattggctatctcagccaaggattttctggaatgaaatcttgtggaaagtcaaggcttatttgttgtgacatgaaaatatatgggacaagtctctctctatttgtacagattgttgcaacttccataatttttttaggggtaaaaagagaaaacaagagggaaaagaaaaaccacaggagtcacgcaggctgtagaatatatagtttatatttttttctcatttttctagaaattttcagatatattttcgtatgtcctaatcttggccataaaacaaagtaatgttaggtttgtgtccttggc

SEQ ID NO: 12 - protein, 652 aa, Arabidopsis thaliana
MGEVADTMTKKKKKGRPSLLDLQKRAIKQQQQQLQQQQQQHKNNHQDDDDHHHNNNNRSGSKNPNSLNHRSKRRNPNSNDGDSPWIKDEGEDNDDDERREKKHKLLHGLNSHSHRHSPNSQSDLNLDQTPEPSFNRRNLSAAASGSDYHTGEKASKATDILQGSPVESGPTTPLPDKKLLLFILDRLQKKDTYGVYSDPVDPEELPDYFEIIKNPMDFSTLRNKLDSGAYSTLEQFERDVFLICTNAMEYNSADTVYYRQARAIQELAKKDFENLRQDSDDEEPQSQQQQQQQPKVARRGRPPKKHPEPSSIDRTASEISADALIPGDSSNKFSGAYNLRKAPPSYKFRQAESSVRINHNSETQSGWSVDWESEFPSSVVKAVNKYGMKHFNVDDNRRDTYNHLSTSTQEPSVLTTLEDELKQLIPVGLNMEYGYAKSLARYAANLGPVAWKIASRRIETVLPSGIKFGQGWVGENPAGPEEDDSQKQNILMSSGKQKCSNDLASDDHSNRILSPTASVSSAFIGNRHASSQAIEETTPPPARVLNPEIDHPSSSSHQAGLLIKTESSNGLIRGFNHNANQMLGIARQQQPNVSNEATPVSQQQGSLFPYPKQEFHRFPPDLNARLVSPNSPGSNQQTGSSSSQHPDLALQL

SEQ ID NO: 13 - DNA, 2737 bp, Arabidopsis thaliana
aaagaaattgcgagaaaaaggtttggtgtttagctcgagagctggaaatcagaacgactcggaggagagaagacaaagaaagcaattctttttactaagggtcttgcttcgattccacagaacccaaaacctctatttctctatcttcatccacaaaaatgccagcttctgaagatagaagagggaaatggaaaaggaagaagagaggggggttatcggcggcgaggaaaccgaaacaagaggaggaagatatggaggaagaagacgaagagaataacaacaacaacaacgaagaaatggatgacgttgaaaatgccgatgagcttcagcaaaacggcggcgcaactcccgatccgggacttggtattggcgaggtagttgaagattctggttcgcgcatctctgatttcccggcagtggttaagcgtgttgtgatccggccacacgcgtctgtaatggctgttgtggcggctgagagagctggtttgataggggagactagagggcaaggttcacttccagctctggagaacatttcgtttgggcaattgcaagcgttatctactgtacctgctgattctcttgatcttgagaggagtgatggatcgtcttcggcttatgttatctctccaccacctattatggatggagaaggagttgttaaacggtttggggatctggttcatgtcttgcctatgcattcagattggtttgcaccaaacacagtagatcgacttgaaaggcaagtggtgccacagtttttctctgggaaatcgccaaatcatacacccgaaagttatatggaattcaggaacgccattgtttccaaatatgtagagaaccctgaaaagacactgacgatttctgattgccaaggattggtagatggtgttgacattgaagattttgcacgagttttccgttttcttgatcactggggaataatcaattactgtgccactgcccagtcacatcctggccctttgagagatgtatcggatgtgagggaggacacaaatggcgaggtcaatgtgccgtctgctgctttaacatctattgatagtttgatcaaatttgacaagcccaactgtagacacaaggggggtgaagtctattcatccttgccaagtttggatggtgacagccctgacttggacatcagaattcgtgaacacctatgtgatagtcattgcaaccattgttctcgaccgcttccaactgtgtacttccaatcgcaaaagaagggggatatactcttatgctgtgattgttttcaccatggaagatttgttgttggacattcttgtcttgactttgtaagagtggatccaatgaaattttatggcgatcaagatggagacaattggactgatcaggaaactctcttgcttcttgaagctgtggaactctacaatgaaaattgggttcaaattgctgatcatgttggttccaagtcaaaagctcaatgcattcttcattttcttcgattacctgtggaggatggtctattagataatgttgaggtttctggtgtaactaatacggaaaaccctacaaatggatatgaccacaaaggaacagattcaaatggggatttacctggatattccgagcaaggttctgacactgagatcaagcttccatttgtgaagtctccgaatccggttatggcattggttgcatttttggcatcagctgttggacctcgagttgctgcgtcctgtgcccatgaatccctctcggttttatctgaggacgataggatgaaatctgagggaatgcaagggaaagaagccagcttgcttgatggagaaaatcaacagcaagatggagcacacaaaacatcaagccaaaacggagcagaagcgcagactccactgccacaggataaggttatggcagcatttagagccggtctatcagctgcagcaacaaaagcaaaattgtttgctgatcatgaggaacgcgaaatccagagactttctgctaatatcgttaatcaccagctgaagaggatggagctgaaattaaagcagttcgcagaaattgaaacactgttgatgaaagaatgcgaacaagtagagaaaacccgtcagagattttctgcagaacgggctcgtatgctctcagcaagatttggatctcctggaggaatctctccacagactaataatctccaaggcatgtctctatccacaggtggtaacaacatcaattctctcatgcatcagcaacatcagcaacaacaagcttccgcaacttctcaaccaagcataatcccaggattcagcaacaacccgcaagttcaagcacagatgcatttcatggcacgacaacaacaacaacaacaacaacaacaacaacaacaacagcaagctttctcgtttggcccgagattacctctcaatgcaatacagaccaatgcaggatcaacagcttcaccaaacgtcatgtttggcaacaaccaactaaataaccctgcagcagctggagcagcatcgatcaaccagccttcgtttagtcacccgatggttaggtcttccacaggttcaggctcagggtccggcttaggcttaaactaagatccatctttctctagcttatttagcttatcagtatccatatttatttcaccttgttatttttaaagataagttatttggctttgagaccgtagtcttgttccaagttagtgtcttgtagtatcaaaccatcatcatcatcattgtgaattaaa

SEQ ID NO: 14 - protein, 807 aa, Arabidopsis thaliana
MPASEDRRGKWKRKKRGGLSAARKPKQEEEDMEEEDEENNNNNNEEMDDVENADELQQNGGATPDPGLGIGEVVEDSGSRISDFPAVVKRVVIRPHASVMAVVAAERAGLIGETRGQGSLPALENISFGQLQALSTVPADSLDLERSDGSSSAYVISPPPIMDGEGVVKRFGDLVHVLPMHSDWFAPNTVDRLERQVVPQFFSGKSPNHTPESYMEFRNAIVSKYVENPEKTLTISDCQGLVDGVDIEDFARVFRFLDHWGIINYCATAQSHPGPLRDVSDVREDTNGEVNVPSAALTSIDSLIKFDKPNCRHKGGEVYSSLPSLDGDSPDLDIRIREHLCDSHCNHCSRPLPTVYFQSQKKGDILLCCDCFHHGRFVVGHSCLDFVRVDPMKFYGDQDGDNWTDQETLLLLEAVELYNENWVQIADHVGSKSKAQCILHFLRLPVEDGLLDNVEVSGVTNTENPTNGYDHKGTDSNGDLPGYSEQGSDTEIKLPFVKSPNPVMALVAFLASAVGPRVAASCAHESLSVLSEDDRMKSEGMQGKEASLLDGENQQQDGAHKTSSQNGAEAQTPLPQDKVMAAFRAGLSAAATKAKLFADHEEREIQRLSANIVNHQLKRMELKLKQFAEIETLLMKECEQVEKTRQRFSAERARMLSARFGSPGGISPQTNNLQGMSLSTGGNNINSLMHQQHQQQQASATSQPSIIPGFSNNPQVQAQMHFMARQQQQQQQQQQQQQQAFSFGPRLPLNAIQTNAGSTASPNVMFGNNQLNNPAAAGAASINQPSFSHPMVRSSTGSGSGSGLGLN

SEQ ID NO: 15 - DNA, 3231 bp, Arabidopsis thaliana
aattatggtttacgaagactgagaagaaaaaaacgagcatcgtccatcgagatccaaatcctcagtttcattttcatctctctctctcgtattgatcagctactcgaaactccggtaacggattttcacaatcccggcggcgaaactcttcttcccggctaagttttcattttcttcagattcctcgtaaagttgccggtggaccaaggtccaactcttgaacaccccaaatcatgaatcccttttcttctggtactcgtttaagggacatgatccgtgccataagagcatgcaaaacagctgcggaggagcgagctgttgtaagaaaggagtgtgccgatattcgagcattgattaatgaagatgacccgcatgatcggcaccggaaccttgcgaaactcatgtttatacacatgctgggttatcccacacactttgggcagatggagtgcttgaagctaattgcatctcctggatttccagagaagaggattggatatctagggctaatgttgcttcttgatgagagacaagaagtgttgatgcttgtcacaaattcgttaaaacaagatcttaatcactcgaaccagtatgttgtaggacttgctctctgtgctttagggaatatttgttcagcagaaatggcccgtgatcttgcgccagaagtagaaagattaatccagtttcgtgaccctaatatccgaaagaaggcggcgctttgctctactagaataataaggaaagttccagatctagcagaaaacttcgtaaatgctgctgcttccttgcttaaagaaaagcatcatggggttcttataacaggagttcaactttgttatgaattatgcacgattaatgatgaagccctagagtacttcagaacgaaatgcacagagggactgataaaaactttgagggatattactaatagcgcatatcagcctgagtatgatgttgcagggatcacagacccttttctccacatacggttgctcaggctcttgcgtgttttaggccagggtgatgctgatgctagtgatttgatgacagatatacttgcacaggtggcaacaaaaactgaatcaaacaaaaacgcagggaatgcggtactctatgagtgtgttgaaacaatcatggccattgaagacaccaatagcttgcgtgtgcttgctatcaatatcttgggaagattcttatctaaccgcgacaataacatcagatatgttgcattaaacatgctgatgaaagctatcactttcgatgatcaagcagtgcaaaggcacagagttacaattttggaatgtgtgaaggacccagatgcttctatccggaaaagagctcttgagcttgtcactcttttggtgaatgaaaacaatgtcacacaactgacaaaggagctaattgattatttggaaatcagcgacgaagattttaaggaagatcttagtgcaaaaatttgttttatcgttgaaaagttttctccagaaaaactatggtacattgatcagatgctcaaggttctgtgtgaggctggaaagtttgtgaaagatgatgtgtggcatgcacttattgttgtcataagcaatgcatcagagcttcatggatatacagttagggccttgtacaaatcagtcttgacttattcggaacaggagacccttgtccgagtggcggtatggtgcattggggaatatggtgatctgttggttaacaatgtggggatgcttggtattgaagatccaataacggtaacggaatctgatgcagtggacgttatcgaggatgccattactcgccataactcagattcgactacaaaagcaatggcattggttgctctactgaagttgtcatcccgctttccttctatttcagagagaattaaagacataattgtgaagcagaaaggaagccttctccttgaaatgcagcagagagctattgaatacaattctatagttgacaggcataaaaatatcaggtcttctctggttgacagaatgccggtactggatgaggctactttcaatgtgaggagggccggctcttttcctgcatcagtttcaaccatggccaagccttcagttagccttcaaaatggtgttgagaaacttcctgtcgctcctcttgtggacttgctagacctagattctgacgatatcatggctgcacctagtccatctggtacagatttccttcaggatcttctcggtgtagacttaggttcatcgtcagcacaatatggtgcaacccaggctccaaaagctggcacagatctgttgctggatattctatcaattggaacaccttctcctgcacaaaacagcacatcatctattggtttattatcaatagctgacgttaacaataatccctcaattgcgctagacacactttcttcaccagctccacctcacgtagcaacaacttcgtccaccggtatgtttgatttgctagatggtctttctccaagcccatcgaaggaagccaccaatggtccagcttatgcacctattgttgcatacgagagcagctccttgaagattgagttcaccttctcaaagacaccagggaatctgcaaacgacaaatgtccaggctacttttactaatttatctcccaatactttcacagattttatattccaggctgctgttccaaagttcctccagctgcacttggatccagctagcagtaacacactcctggcaagcggtagtggtgccatcacgcagaatctaagagtcactaacagccagcaggggaagaaatctcttgtgatgcgcatgaggattgggtacaaactgaacggaaaagatgtattagaggaaggacaagtcagcaacttccctcgcgggttgtgaaactcatcgatcagccattgtattttcagcataaggacttgagtgtttctttctatcaaacccaactaaaaaagaaagacaagtcttgcccaagccgttgatgcagctttctccttccaattttttcatccgttttatgaaacaagtagtactttggcctttgcttgtgatttgaggttcttgggttttctttttgtacaaaagttttgatgtttggaatcggaaagtggtcaagaagtagaatttgtctctcatgtctctgagactataaaaaagatgtgatttatgacccataaccataactcatgatgtatctactacagttacaattttcgtcttgcaaagaaggagtattggattttggatc

SEQ ID NO: 16 - protein, 876 aa, Arabidopsis thaliana
MNPFSSGTRLRDMIRAIRACKTAAEERAVVRKECADIRALINEDDPHDRHRNLAKLMFIHMLGYPTHFGQMECLKLIASPGFPEKRIGYLGLMLLLDERQEVLMLVTNSLKQDLNHSNQYVVGLALCALGNICSAEMARDLAPEVERLIQFRDPNIRKKAALCSTRIIRKVPDLAENFVNAAASLLKEKHHGVLITGVQLCYELCTINDEALEYFRTKCTEGLIKTLRDITNSAYQPEYDVAGITDPFLHIRLLRLLRVLGQGDADASDLMTDILAQVATKTESNKNAGNAVLYECVETIMAIEDTNSLRVLAINILGRFLSNRDNNIRYVALNMLMKAITFDDQAVQRHRVTILECVKDPDASIRKRALELVTLLVNENNVTQLTKELIDYLEISDEDFKEDLSAKICFIVEKFSPEKLWYIDQMLKVLCEAGKFVKDDVWHALIVVISNASELHGYTVRALYKSVLTYSEQETLVRVAVWCIGEYGDLLVNNVGMLGIEDPITVTESDAVDVIEDAITRHNSDSTTKAMALVALLKLSSRFPSISERIKDIIVKQKGSLLLEMQQRAIEYNSIVDRHKNIRSSLVDRMPVLDEATFNVRRAGSFPASVSTMAKPSVSLQNGVEKLPVAPLVDLLDLDSDDIMAAPSPSGTDFLQDLLGVDLGSSSAQYGATQAPKAGTDLLLDILSIGTPSPAQNSTSSIGLLSIADVNNNPSIALDTLSSPAPPHVATTSSTGMFDLLDGLSPSPSKEATNGPAYAPIVAYESSSLKIEFTFSKTPGNLQTTNVQATFTNLSPNTFTDFIFQAAVPKFLQLHLDPASSNTLLASGSGAITQNLRVTNSQQGKKSLVMRMRIGYKLNGKDVLEEGQVSNFPRGL

SEQ ID NO: 17 - DNA, 838 bp, Arabidopsis thaliana
agatcattatcttagaaatatccttttatctcattctggaaacttcttaccataacagaaaataaacaaatctcattccggaaaacgctcataaattgtccgaaagccctaaaaatctgagtctcgcattaagtccaaacactttcatttgtctcctttcgtcaactccacagagatctcctcatggctccaattgctgtcggcgatgtcgtaccagacggaactatctccttcttcgatgagaatgatcaacttcagaccgcctccgttcactctctcgccgccggtaaaaaagtcattctctttggtgttcctggtgctttcactcccacttgcagcatgaagcatgttcctgggttcattgagaaagcagaggagctgaagtcaaagggtgttgatgagatcatttgctttagcgtgaacgatccgtttgtgatgaaagcatggggaaaaacatacccagagaacaaacatgtgaagtttgtagctgatggggtcttggtgttaggtcaaggagatttgctctgttacttgatgatctcaaagtgactgtagccaatgtcgaatctggtggcgaattcacagtttccagcgccgatgatatcctcaaggctctctaagaaatgtaccacttgtgttgtctatgtaaaccgctgtatgtgtagtagaggattctatagcttgttctcagacattaaccaaggttgtaataaagcggtttcattgtgacttgtttggcataacaaagtatttggttttgttgtttttctgtgcgttgattaatgaaagatgtgactcattgacgtgaacatttatgccaaattttgccattgttgtt

SEQ ID NO: 18 - protein, 121 aa, Arabidopsis thaliana
MAPIAVGDVVPDGTISFFDENDQLQTASVHSLAAGKKVILFGVPGAFTPTCSMKHVPGFIEKAEELKSKGVDEIICFSVNDPFVMKAWGKTYPENKHVKFVADGVLVLGQGDLLCYLMISK

SEQ ID NO: 19 - DNA, 1496 bp, Arabidopsis thaliana
gcttttgactcacttttttaatctttttggattttggtgaaaaagtttaatttgtctctttctctatttatctccggcgtcaatttcacggcggctacacgacggttatcgatgtcattgactgtaccggagttcgatttcagattgacgccacagtttggtttctcacagtcaccgatcggggagcgtaatttcgcggatgttgataatctggagaactgtattaagtatttgaatcagagcttagtcacctctggattctctgcttcgcttgacctcttcgctaccgatcctgtttcgattgctagaacttgcaattgcgtatacgctttgattcaacagaggcaacgagatgtggaatttagagaatctgctaatgatcagagacaacgacttttatccgatatggcgagactcgaagcaaaagttgaaaggcttgagactcaattgcaagctaaagaaagggaacttggttcggtgacaagaacggaagcaaaaaatacagcggctttaaagacgcagaatgagaagcttcaaaaagagagagatgagtttcaacgaatggtgattgctaaccagcaagtcaagacccaacaattacatgaaacaaaaaagaaagaaaaagagtacataaagttacaggagaggttaaaccaagtgttgatggagaaaaagaaggaaacgagatcaggcatggagattatgaatctactccagaaagaagggagacagcgtggaacatggagtgggaagaaaactgactctgatttctacaaaaaaattgtggatgcatatgaggcgaaaaatcaagaactgatggcagagaacactgatctgagagcgttactacgatcaacgcagggtgacatgcgttctttcttgaatgcttctggtggattaaccaaccaatctttggtagctaatggaagacacggtgcagacccttctcagtctcctttgggcgggaagacggacgtttttgacctaccttttcgtatggcacgaggtcaaatagaagatagtttacgctctaagatggtttccatcaaggaacgtatgggtcagttagtagatgcacaaaaagaagtatccattacttcagaagcgtcagagagggaacttgaacttgaagcacaactcgtcgaggcacgcagcattattcaagaacaggaatctataatgtccaaacatttacctaagacagatcggagaaggaactcagctcctccacattcttctgtcaacggactgcgtggctgactaattagattgtgaatctcaggttcaaaatatcaaatctcttcctgtaatttgatcttgctaaacaaagaaatgttttatgaacttataaaaaaatttaaatgaatgtggattcgtatttgtaacgttgtacagaacacttgcagacagcaagctgcaagctgtagagtattatagatggagagatatgttttatatcataatatagatgcctttctttataaaagaaatcgaat

SEQ ID NO: 20 - protein, 284 aa, Arabidopsis thaliana
MARLEAKVERLETQLQAKERELGSVTRTEAKNTAALKTQNEKLQKERDEFQRMVIANQQVKTQQLHETKKKEKEYIKLQERLNQVLMEKKKETRSGMEIMNLLQKEGRQRGTWSGKKTDSDFYKKIVDAYEAKNQELMAENTDLRALLRSTQGDMRSFLNASGGLTNQSLVANGRHGADPSQSPLGGKTDVFDLPFRMARGQIEDSLRSKMVSIKERMGQLVDAQKEVSITSEASERELELEAQLVEARSIIQEQESIMSKHLPKTDRRRNSAPPHSSVNGLRG

SEQ ID NO: 21 - DNA, 10972 bp, Arabidopsis thaliana
cttcttcacttgtcagctctcaacgtttctcacctgaaatttcacttctgcttcgtcttctcgagccggatctctaatttggaattcttatgtgatggtgtaatttaagttaagatgacgtcttcttcgcataatattgagttggaagcagctaagtttctgcataaacttattcaagattctaaagatgaacctgcaaagctagcaactaaactttatgtgatattgcagcacatgaaaaccagtggaaaggaaaacacaatgccctatcaagtcatatctagggccatggacactgtagtcaatcaacacggtcttgacattgaagctttgaagtcctcgtgtcttcctcatcctggtggtacccaaacggaagattctgggtctgcacatttggctgggtcttcccaagcggttggagttagcaatgagggtaaagcaactctagttgaaaatgagatgacaaaatacgatgcattcacttctggtaggcagcttggtggatcaaacagtgcgtcacaaaccttttaccaagggtctggaactcaaagtaacagatcatttgatcgtgagagtccatccaacttggattctacgtctggaatttctcaacctcacaatcgtagtgagacaatgaatcaaagagatgtcaagtcgagtggaaagagaaagagaggtgaatcatcactttcatgggaccagaatatggataactctcaaatatttgatagccacaagattgatgatcaaactggagaagtaagcaaaatagaaatgcccggtaattcaggtgacattaggaatttgcatgttgggttgtcctcagatgcattcacgactccacagtgtggctggcagagcagtgaagccacagcaatcaggcctgcaattcataaagaacctggaaataatgttgcaggagagggattcctgccttcaggttcaccttttagagagcaacaactgaagcagctcagagcccagtgccttgtgtttctagctcttagaaatggtttggtaccgaagaaacttcacgtagagattgcccttcgaaatactttccgcgaagaagatggtttccgcggagaattgtttgatccgaaagggagaacacatacgtccagtgatctgggtggcattcctgacgtctctgcactgttgtcaagaacagacaatcccactggaagattggatgaaatggacttctcatccaaagaaactgagagatcaagactaggggaaaaaagtttcgcaaatactgtattttctgacgggcaaaagcttctagcatctagaattcccagctctcaagcacaaactcaggttgctgttagtcattctcaactaacgttttctcctggtttgaccaaaaacacaccatcagagatggtggggtggactggagtaatcaaaactaatgacctctcaacttctgctgttcaactcgacgaatttcattcttctgatgaagaggaaggtaatttgcaaccgtcgcctaagtacaccatgtcacagaaatggattatgggtcgacagaataagagactattggttgatcgtagttggtcccttaaacagcagaaagccgaccaggcaattggttcacggttcaatgagttgaaggaatctgtgagtttgtctgatgatatatctgcaaagaccaagagtgtaatagaactgaaaaagcttcagctgttaaatctacaacggcgattgaggagtgagttcgtttacaacttcttcaaacctattgcaactgatgttgagcatctaaagtcatataagaaacataagcatggccggagaattaagcagcttgaaaagtatgagcagaagatgaaggaagagagacaacgaagaattcgggagagacagaaggagttctttggagggttagaagttcacaaggaaaaactagaggatttgtttaaagttaggagagaaaggttgaagggtttcaatagatatgcaaaggagttccacaaaagaaaggaacgacttcaccgtgagaagattgacaaaattcaacgtgagaagattaatttgttaaagataaatgatgtggagggttatctccgaatggtgcaggatgccaagtcagatcgagtaaagcaactactcaaagagactgaaaagtaccttcagaaacttggatccaagttaaaagaggctaaattgttgaccagtcgatttgagaatgaggcagatgaaacgcgtacgtcaaatgctaccgacgatgaaactttgattgaaaatgaagatgagagcgaccaagcaaagcattacctggaaagcaacgaaaaatactacttgatggctcacagtataaaagaaaatattaacgagcagccatcgtccctagtgggtggaaagttaagagagtaccaaatgaacggcttaaggtggctagtttcactgtacaacaatcacttaaatggcattttagctgatgagatgggtctcgggaaaactgttcaggttatttctttgatttgctatctgatggagacaaaaaatgatagaggtcccttcttggttgttgtcccatcttcggttctgcctggttggcagtcagaaattaacttctgggccccatcaattcataaaattgtttactgtgggactcctgacgaaaggcgcaaactattcaaggagcaaattgttcatcagaagttcaatgtccttctgacgacatatgagtatctaatgaacaagcatgataggcctaaattaagcaagattcactggcactatattattattgacgaaggacatcgcataaagaatgcatcctgcaagttaaatgcagacctgaaacattatgttagctcccaccgacttctgttaactgggaccccattgcagaacaacctagaagaattgtgggcactgcttaatttcctgctgcctaatatattcaactcgtcagaagacttttcacagtggttcaacaaaccattccaaagtaatggagaaagttctgccgaggaggcattgctatcagaagaggagaatctactgatcatcaatcgacttcaccaagttcttcgaccatttgttctgcgtcggctgaaacataaggttgaaaatgagcttcccgaaaagatagagagattgatacgctgtgaggcttctgcttatcagaagctgttgatgaagagggttgaggataatttgggttcgattggaaatgcgaagtctcgtgcagtgcacaactcagtaatggagcttcggaatatttgcaatcatccatatcttagccaactgcattcagaggaggtcaataacataattcctaagcatttcctgcctccaattgtaagactgtgtggaaagcttgagatgttggatcggatgttgcctaaactcaaagcaacagaccatcgggttcttttcttttccacaatgacaaggcttcttgatgtaatggaggattacctcaccttaaaggggtacaaataccttaggctggacgggcagacatctgggggtgatcgtggtgctcttattgatggtttcaacaagtcgggttccccatttttcatatttctgttgagcattcgggctggtggagtaggagttaatcttcaagctgctgatactgtgatactattcgacactgactggaatcctcaggttgatctgcaagctcaagctagggctcacaggattggccagaaaaaagatgtgcttgttcttcgttttgaaacggtgaattctgttgaggagcaagtcagagcttcagctgagcacaaacttggagttgctaaccagagtataaccgctggcttttttgacaataacacgagtgctgaagatcgtaaggaatatttggaatcccttttgcgtgaatcaaagaaagaggaggatgctccagtattggacgatgatgccttaaatgatcttatagctcgaagggagtcagagattgatatctttgagtccatcgacaaacaaaggaaagaaaatgagatggaaacatggaataccttggtacatgggccagggtcagatagttttgcccacataccatctataccctctcggcttgttactgaagatgatttaaaactactatatgaaacaatgaaactaaatgatgtccccatggttgcaaaagaatcaactgttggcatgaagcggaaggatggttcgatgggaggcctagatactcaccaatatggaagagggaaacgagcaagagaggttcgatcttatgaagagaaattaactgaggaggagtttgagaagctgtgtcagactgagtcacctgattcaccccaaggcaagggcgaaggaagtgaaaggagcttggcgaatgatacatcaaatattccggttgaaaattctagtgacacactactccctacatctccgacacaggcaattactgtacaaccaatggaacctgtaaggccacagtcacatacactgaaagaagaaacacaacctataaaacgtggtcgtggtaggccaaagagaactgataaagccttgactccggtatcattatcagctgtaagcaggacacaggcgacagggaatgctatatcatcggcagcaactggtcttgattttgttagttcagataaaaggctagaagccgcttctcatcctacttcgtctcttgccctgacttcgcctgatttatctggtcctcctggttttcaatcattgccagcatctcctgctcctacgccaataagaggccgaggtaggggaagaagcagggggcgtggagcaggaaggggaagaagagttgaaggtgtattgcatggttccaacagttctattactcagagaactgaaaccgctacatctcttgcaagtgatgcagaagccacaaaatttgctcttcctcgttctgcatctgagattgtttcaagagtccctaaagctaatgaaggaagtacttcgaatcctgaccaagtatctcccgtgcattctgccactactgcactccgatcagacaaagcagcagataaggacctagatgcaccacctggttttgattcgggatcccatgttcagacgctaaatgtacttgaaaattcatcggaaagaaaagcatttgctgtaaagaagaggcctttgatccaaggtgtgagctcccagcatccagggcctaataaacagccacttgacttgccagtctccactagctccactttgttgggtggtggcccagtgcaaaatcagaatgccgtctcttctgtttgtgatggatccaaaagtccttctgagggtcgaacatatacagctttgcaaggtgtgacaactgcaccttctgatgctactctgccaatgagttctcaaccttctgatgctactctgccaatgagttctcaacctgtcggttctacggttgaagctcaagaagccaatgttccttctcttccagcagccttgcctgctaagaggcgagtccgcaatttgccaagcagaggagaaactcctaaacgccaaggaaagaggcgtggccaacctttacctgcaaccgatgcctcttctgcaaggagtacaggattaacaccacaaatagaggtcaaggttggtaatttatcaggcaccaaagctaagtttgatgctgttgccaaagaacaaccccacttcagccagtcagttgcacccgatattcactcttctggtagtttgagtcaggaaattagaagagacacctctggtactggtggttctgctaggaaacaaactgctgatgtaactgatgttgctcgagtcatgaaagagatcttttcagagacttccctattaaaacataaagttggagagccttctgcaacaacgagaacaaatgtgcctgacgcacaatcccctggtgagatgaatttgcacacagttgagacccacaaggcagaggattcttctggtcttaagaatcaagaagctttatataacctgagcaaggcagataaactggtatcagatattcctcatcctgttcctggtgatctgacaacttcaggatcagttgcaaacaaagatgttgacattgggtcgtctaaggttgctgctgaaaatgagcttgtcaaaattccgggtggtgacgtagattcttctgtaatacaactctctttgggaaatactttgactgctaaatcgtctttggaaaagtgcactgcagatcagcttctgggagaaaaactgtctcaagaaggtgaaaccacacctgctagtgatggtgaaacatgtcacctggcagaagaaacggcatcttcattgagttatgttcgatctgagcctactgcatctgcgtcgacaactgcggaacctctacctactgacaagttggaaaaaaatatttcttttcaagatgaagttaaaactctcaatggtgataaaagagaagctatcctcctaagttcggaagagcaaacgaatgttaactccaagattgagacaaattctgaggaacttcaagccagtagaacagatgaagttccacatgtggatggaaaatctgttgatgttgcaaatcagacggtgaaagaagatgaggcaaaacattctgttgaaattcaatcgtctatgctggagcctgatgaactgccaaatgctggacaaaagggtcacagtagcattgacttgcagccattggttttagttacaagcaatgagaatgctatgtcccttgacgataaagattatgatcctatctctaaatctgctgatatagaacaagatcctgaagaatctgtttttgttcaaggtgttggtaggcctaaagttggtactgctgatacacagatggaggataccaatgatgccaaacttctagtgggttgttcagttgagagtgaggaaaaagagaaaactcttcaatccctcatacccggtgatgatgctgatacagaacaagatcctgaagaatctgtttcggatcaaaggcctaaagttggttctgcttacacacagatggaggatacggatgaggcgaaacttctaatgggttgttcagttgagagtgaggaaaaagagaaaactcttcaatcccatatacccggtgatgatgctgatacagaaaaaaatcctgaagaatctgtttccgttcaaggtgttgataggccgaaagttggtactactgacacacagatggaggataccaatgatgccaaacttctagtgggttgttcagttgcgagtgaggagaaagagaaaactcttcaatcccatatacccggtgatgatgctgatacagaacaaaatcctgaagaatctgtttcagttcaaggtgttaataggcctaaagttggtaatgctaacacacagatggaggatacggatgaggccaaagttctagtgggttgttcagttgagagtgaggagaaagagaaaactcttcaatcccacatacctggtgatgatgctgatacagaacaaaatcctgaagaatctgtttcgaattttgataggcctaaagatgggactgctgacacacatatggaggatatcgatgatgccaaacttctagtgggttgttcagttgagagtgaggagaaagagaaaagtcttcaatcccatatgcccagtgatgatgctgttctccatgcgccttttgagaacacaaaagacagtaaaggagatgatttacatggagagtctcttgtttcctgtccaacaatggaagtgatggaacagaaggggtttgaatcagagacacatgctcgtacagattcaggtggtattgataggggaaatgaggtatcagaaaatatgtctgatggcgtcaaaatgaatatttcatctgtgcaggtcccggatgcatcacatgatttaaatgtatcacaggatcaaacagacattcccctagttggtgggatagaccctgaacacgtacaagagaatgtggatgtacctgcatcacctcacggagcagcgccaaacattgtgattttccagtctgagggacatctgtctccaagtatcttaccggacgatgtggcaggacaactagaaagcatgtctaatgacgaaaaaacgaatatttcatctgagcaggtcccagatgtatcacatgatttgaaagtgtctcaggatcaaactgacattcccccagttggtgggatagtgcctgaaaatttgcaagagattgtggatgtacctgcatcacctcatggagtagtgccagacgttgttgtttcccagtctgaggaaattcaatctccaagtattttgcccgacgatgtaccaggacaaccagacgatggcaactgtgagaaaatggataccatgcagaacaatacctctattgatattggcataacttcaggtaagacatgtcagccttcatcttctacccagcctgaggatgagaacagaaatagcttatcacactgtgaaccgtcagaagtagttgaacaaagggattcaagagatcaagtttgcatagggtctgtggaatctcaagtagagatcagctctgctatactggaaaatagatcagctgatatccagcccccgcaatccattttggttgatcaaaaggatattgaagaatccaaagaacctggtatcgagagtgctgatgtgtctttacaccaattagctgatatccaggccgagccatccaatttggttgatcaaatggatattgaagaatccaaagaacctggtaccgagagtgctgatgtgtctttacaccaattagctgatatccagcccgggccatccattttggttgatcaaatggatactgaaaaatccaaagaacctggtaccgagagtgctgatgtgtctttacaccaattagctgatatccagcccgggccatccattttggttgatcaaatggatactgaaaaatccaaagaacctggtaccgagagtgctgatgtgtctttacaccaattagctgatatccagcccgggccatccattttggttgatcaaatggatactgaagaattcaaaaatcctgatgtgtctttacaccaattagctgatattgagccctcactgtctatttcagctgtgcaaaagaatattgaggataaggatcaaagtcacgttgaaactgctggatctgagttagttgatgtctctgccgaatgttcaacagaacctcaagttcaattaccgccatcttcagagccagtgggagatatgcacgttcatttaggggcaagcaaatcagaaatagttgccgaaggtactgacttctcttcatctctcccgaagacggaggaagaaaatgccaagagccaattagctgacaccgagccatcatcgtctcttacagctgtgcaaaagaacattgaagatcaagttgaaactgctggatgtgaatttgttgttgtctctaccggatgttcaacagaaccacaagttcaattaccgccgtccgcagagccagtggttgctgaaggtacagaattcccttcttccctcctaatgaccggggtagataattcttcccatctaatgaccggggtagataatgccaagacccatctcgctgatgttgtgccttcatcgtcacctacaactatggaaaagaacattgaagctcaagatcaagatcaagttacaactggtggatgtggtctagttgatgtcttgaccgaatgttcgtcagaacctcaacttcaactgccgccatccgcagaaccagtgatttctgaaggtacagaactcgctacactcccattgacggaggaagaaaatgctgatagccaattagctaatattgagccctcatcgtctccttcagttgtggaaaagaacattgaggctcaagatcaagatcaagttaaaactgctggatgtgagttagtctcgactggatgttcgtcagaaccacaagttcatttaccgccctccgcagagccagatggagatatacacgttcacttaaaggaaacagagaaatctgaaagcatggttgtggttggcgaaggtacagcattcccttcatctctcccagtgacagaggaaggaaatgctgagagccaattagctgacactgagccctttacgtctcctacagttgtggaaaagaacattaaggatcaagaacaagttgaaactactggatgtgggttagttgatgattctaccggatgttcgtcagaacctcaagttcaattaccgccatccgcagagccaatggaaggtacacacatgcacttagaggaaacaaagaaatctgaaactgtagttaccgagattcaattagctgatatagatccctcattttctcttatagttgtgcaaacgaatattgaggatcaagatcaaattgaaacaggtggatgtgatttaattaatgtcccttccggatgttcaacagaacctcaaattcaattatcgtcatccgcagagcccgaggaaggtatgcacattcacttagaggcagcaatgaactctgaaacggtggttactgaaggttcagaactcccttcatctctcccaatgacggaggacgaaaatgctgatggccaattagctgaagtcgagccctcagtgtctcttacagttgagcaaactaacattgaggagaaagatcacattgaaactgccgaatgtgagttagttgatgtctctcccggatgttcatcacaacctgaagttaaatttccgccatccccagatgcagtgggaggtatggacgttcacttagaaaccgttgttactgaagacacagattcaaattcatccctcccgaagacggaggaaaaagatgccgagaatccatcagacaggcttgacggtgaatccgatggtacaactgttgctactgttgaaggaacttgtgttgagtcgaattcattggtcgccgaagagagcaacatagaagtgccaaaagacaatgaagatgtgtagttcatttcatctaatattaagttgtaaaacttttaatatctaatataacaaacccaatgttgaagatgtattgactgcatctgacttatttaacttatcctctcatttgggaatattaatagggcttagaatc

SEQ ID NO: 22 - protein, 3529 aa, Arabidopsis thaliana
MTSSSHNIELEAAKFLHKLIQDSKDEPAKLATKLYVILQHMKTSGKENTMPYQVISRAMDTVVNQHGLDIEALKSSCLPHPGGTQTEDSGSAHLAGSSQAVGVSNEGKATLVENEMTKYDAFTSGRQLGGSNSASQTFYQGSGTQSNRSFDRESPSNLDSTSGISQPHNRSETMNQRDVKSSGKRKRGESSLSWDQNMDNSQIFDSHKIDDQTGEVSKIEMPGNSGDIRNLHVGLSSDAFTTPQCGWQSSEATAIRPAIHKEPGNNVAGEGFLPSGSPFREQQLKQLRAQCLVFLALRNGLVPKKLHVEIALRNTFREEDGFRGELFDPKGRTHTSSDLGGIPDVSALLSRTDNPTGRLDEMDFSSKETERSRLGEKSFANTVFSDGQKLLASRIPSSQAQTQVAVSHSQLTFSPGLTKNTPSEMVGWTGVIKTNDLSTSAVQLDEFHSSDEEEGNLQPSPKYTMSQKWIMGRQNKRLLVDRSWSLKQQKADQAIGSRFNELKESVSLSDDISAKTKSVIELKKLQLLNLQRRLRSEFVYNFFKPIATDVEHLKSYKKHKHGRRIKQLEKYEQKMKEERQRRIRERQKEFFGGLEVHKEKLEDLFKVRRERLKGFNRYAKEFHKRKERLHREKIDKIQREKINLLKINDVEGYLRMVQDAKSDRVKQLLKETEKYLQKLGSKLKEAKLLTSRFENEADETRTSNATDDETLIENEDESDQAKHYLESNEKYYLMAHSIKENINEQPSSLVGGKLREYQMNGLRWLVSLYNNHLNGILADEMGLGKTVQVISLICYLMETKNDRGPFLVVVPSSVLPGWQSEINFWAPSIHKIVYCGTPDERRKLFKEQIVHQKFNVLLTTYEYLMNKHDRPKLSKIHWHYIIIDEGHRIKNASCKLNADLKHYVSSHRLLLTGTPLQNNLEELWALLNFLLPNIFNSSEDFSQWFNKPFQSNGESSAEEALLSEEENLLIINRLHQVLRPFVLRRLKHKVENELPEKIERLIRCEASAYQKLLMKRVEDNLGSIGNAKSRAVHNSVMELRNICNHPYLSQLHSEEVNNIIPKHFLPPIVRLCGKLEMLDRMLPKLKATDHRVLFFSTMTRLLDVMEDYLTLKGYKYLRLDGQTSGGDRGALIDGFNKSGSPFFIFLLSIRAGGVGVNLQAADTVILFDTDWNPQVDLQAQARAHRIGQKKDVLVLRFETVNSVEEQVRASAEHKLGVANQSITAGFFDNNTSAEDRKEYLESLLRESKKEEDAPVLDDDALNDLIARRESEIDIFESIDKQRKENEMETWNTLVHGPGSDSFAHIPSIPSRLVTEDDLKLLYETMKLNDVPMVAKESTVGMKRKDGSMGGLDTHQYGRGKRAREVRSYEEKLTEEEFEKLCQTESPDSPQGKGEGSERSLANDTSNIPVENSSDTLLPTSPTQAITVQPMEPVRPQSHTLKEETQPIKRGRGRPKRTDKALTPVSLSAVSRTQATGNAISSAATGLDFVSSDKRLEAASHPTSSLALTSPDLSGPPGFQSLPASPAPTPIRGRGRGRSRGRGAGRGRRVEGVLHGSNSSITQRTETATSLASDAEATKFALPRSASEIVSRVPKANEGSTSNPDQVSPVHSATTALRSDKAADKDLDAPPGFDSGSHVQTLNVLENSSERKAFAVKKRPLIQGVSSQHPGPNKQPLDLPVSTSSTLLGGGPVQNQNAVSSVCDGSKSPSEGRTYTALQGVTTAPSDATLPMSSQPSDATLPMSSQPVGSTVEAQEANVPSLPAALPAKRRVRNLPSRGETPKRQGKRRGQPLPATDASSARSTGLTPQIEVKVGNLSGTKAKFDAVAKEQPHFSQSVAPDIHSSGSLSQEIRRDTSGTGGSARKQTADVTDVARVMKEIFSETSLLKHKVGEPSATTRTNVPDAQSPGEMNLHTVETHKAEDSSGLKNQEALYNLSKADKLVSDIPHPVPGDLTTSGSVANKDVDIGSSKVAAENELVKIPGGDVDSSVIQLSLGNTLTAKSSLEKCTADQLLGEKLSQEGETTPASDGETCHLAEETASSLSYVRSEPTASASTTAEPLPTDKLEKNISFQDEVKTLNGDKREAILLSSEEQTNVNSKIETNSEELQASRTDEVPHVDGKSVDVANQTVKEDEAKHSVEIQSSMLEPDELPNAGQKGHSSIDLQPLVLVTSNENAMSLDDKDYDPISKSADIEQDPEESVFVQGVGRPKVGTADTQMEDTNDAKLLVGCSVESEEKEKTLQSLIPGDDADTEQDPEESVSDQRPKVGSAYTQMEDTDEAKLLMGCSVESEEKEKTLQSHIPGDDADTEKNPEESVSVQGVDRPKVGTTDTQMEDTNDAKLLVGCSVASEEKEKTLQSHIPGDDADTEQNPEESVSVQGVNRPKVGNANTQMEDTDEAKVLVGCSVESEEKEKTLQSHIPGDDADTEQNPEESVSNFDRPKDGTADTHMEDIDDAKLLVGCSVESEEKEKSLQSHMPSDDAVLHAPFENTKDSKGDDLHGESLVSCPTMEVMEQKGFESETHARTDSGGIDRGNEVSENMSDGVKMNISSVQVPDASHDLNVSQDQTDIPLVGGIDPEHVQENVDVPASPHGAAPNIVIFQSEGHLSPSILPDDVAGQLESMSNDEKTNISSEQVPDVSHDLKVSQDQTDIPPVGGIVPENLQEIVDVPASPHGVVPDVVVSQSEEIQSPSILPDDVPGQPDDGNCEKMDTMQNNTSIDIGITSGKTCQPSSSTQPEDENRNSLSHCEPSEVVEQRDSRDQVCIGSVESQVEISSAILENRSADIQPPQSILVDQKDIEESKEPGIESADVSLHQLADIQAEPSNLVDQMDIEESKEPGTESADVSLHQLADIQPGPSILVDQMDTEKSKEPGTESADVSLHQLADIQPGPSILVDQMDTEKSKEPGTESADVSLHQLADIQPGPSILVDQMDTEEFKNPDVSLHQLADIEPSLSISAVQKNIEDKDQSHVETAGSELVDVSAECSTEPQVQLPPSSEPVGDMHVHLGASKSEIVAEGTDFSSSLPKTEEENAKSQLADTEPSSSLTAVQKNIEDQVETAGCEFVVVSTGCSTEPQVQLPPSAEPVVAEGTEFPSSLLMTGVDNSSHLMTGVDNAKTHLADVVPSSSPTTMEKNIEAQDQDQVTTGGCGLVDVLTECSSEPQLQLPPSAEPVISEGTELATLPLTEEENADSQLANIEPSSSPSVVEKNIEAQDQDQVKTAGCELVSTGCSSEPQVHLPPSAEPDGDIHVHLKETEKSESMVVVGEGTAFPSSLPVTEEGNAESQLADTEPFTSPTVVEKNIKDQEQVETTGCGLVDDSTGCSSEPQVQLPPSAEPMEGGCDLINVPSGCSTEPQIQLSSSAEPEEGMHIHLEAAMNSETVVTEGSELPSSLPMTEDENADGQLAEVEPSVSLTVEQTNIEEKDHIETAECELVDVSPGCSSQPEVKFPPSPDAVGGMDVHLETVVTEDTDSNSSLPKTEEKDAENPSDRLDGESDGTTVATVEGTCVESNSLVAEESNIEVPKDNEDV

SEQ ID NO: 23 - DNA, 6579 bp, Arabidopsis thaliana
atgcaatctggaggcagtggcggagggcccgctcggaatccggccatgggtccggctggtcggactgcttccacgtcatccgctgcttctccttcttcttcctcttcatctgtgcagcagcagcaacagcaacagcaacagcagcaacagcaacagcagctggcgtctaggcagcagcagcagcagcacagaaactcagatacaaacgaaaatatgtttgcatatcaacctggtggggttcagggaatgatgggcggtggcaactttgcttcgtctccgggctctatgcaaatgcctcagcagtctagaaatttttttgagtctcctcagcaacaacaacaacaacaacaacagggttcttctacccaagagggccagcaaaattttaatccaatgcagcaagcgtatattcagtttgctatgcaggctcagcatcaaaaagcacagcagcaagctaggatgggaatggtgggttcatcaagtgtgggaaaggatcaagatgcacgaatgggaatgttgaatatgcaagacttgaatccgtctagtcagccccaggcctcatcatcgaagccatcgggcgatcagtttgctcgcggtgaaaggcagactgaatcaagttctcagcaaaggaacgaaacaaaatctcatcctcagcagcaggtgggtaccggacaactaatgcctggaaatatgataaggccaatgcaagcaccacaggctcagcagcttgtcaataacatgggaaacaaccaactcgcatttgcacaacagtggcaggcaatgcaggcatgggcgcgtgagcgtaatatcgatctctcacatcctgccaacgccagccaaatggcacacatccttcaggcaagaatggctgctcaacagaaagctggtgaaggcaatgtggcctcacagtcaccatctattccaatctctagccagccggcttcatcttcggttgttccaggtgagaattcaccacatgccaactctgctagtgatatctctgggcagtcaggatcagcgaaggccagacatgcattatctactggctcatttgcctcgacttccagtcccagaatggtcaatcctgctatgaatcccttctccggccaagggagagagaatccaatgtatcctcgacatttagttcagcctacaaatgggatgccctcaggaaatcccctgcagacttctgcaaatgagactcctgttttggatcagaatgcatctacaaaaaaaagtttaggtcctgctgaacatttgcaaatgcagcagcctaggcaactgaatacaccgactccaaatttagtagcgccatctgatactggtccactcagtaactcgtcccttcagagtggacaggggacccaacaagcacagcagcgatcaggatttaccaaacagcaactccatgttctcaaagcccagatactggcatttaggcgtttgaagaaaggggaaggttctttgcctccggagcttcttcaagctatttctccaccaccgcttgaactacagacgcagaggcaaatatctcctgccatagggaaagttcaggatagatcttcagacaaaactggagaagaccaagcaaggtcgctagagtgtggcaaggagtctcaggctgctgcttcttcaaatggaccaattttttctaaagaggaagataatgttggagatacagaagtagctttgacgacaggccacagccaattatttcaaaacctgggaaaagaagctacttctactgacgtggctacgaaagaggagcaacagactgatgtattccctgttaagtcagaccaaggagcagattctagtactcaaaagaatcctagaagtgattctacagctgataagggaaaggctgttgcatctgatggaagccaatctaaggttcctccacaagcaaactctccccagccgcccaaggatacagcctctgccaggaaatattatggaccgttgtttgattttccctttttcactcgaaaacttgactcttatgggtctgcaacagccaatgccaataacaatctcacattagcatatgatattaaagatctgatttgtgaagaaggtgcagagttccttagtaagaaaagaacagacagtttgaagaagataaatggtctgctagcaaaaaatttagaaaggaaaaggattaggcctgatcttgttttacggcttcaaattgaagagaaaaagcttaggctatctgatcttcagtctcgtgttagagaggaagtagatcgacaacaacaggagataatgtccatgccggataggccgtaccgcaaatttgtgaggttatgcgaacggcaacgcctagaaatgaatagacaagtactggccaatcagaaagctgtcagagagaagcagctgaaaaccatttttcagtggcgtaagaaactccttgaggctcattgggctatacgtgatgcacgcactgctcgtaacaggggagtggccaaataccatgaaaagatgttgagagagttttcaaagagaaaagatgatggccgcaacaaaaggatggaggccttgaagaataatgatgtagaaagatacagggagatgttgctggaacagcaaactaatatgcctggtgatgctgctgaaagatatgctgttctctcttcatttttgacccaaaccgaagattatcttcataaacttggaggtaagattactgccacaaaaaatcaacaggaagtggaggaggcagcaaatgctgcagcagtagcagcgagattgcaggggttgtcagaagaagaggtcagggcagcagctacttgtgctcgagaagaagttgtgatcagaaatagatttacggaaatgaatgcgccaaaagaaaattcatctgtcaacaagtactatactctggctcatgctgtaaatgaagtggttgtaagacaaccttcaatgcttcaggctggaactttgcgtgattaccagctggttggattacaatggatgctatcgttgtataataacaaattaaacgggatcttggctgatgagatgggtcttggaaaaactgttcaggtaatggcactgattgcttaccttatggagtttaaagggaattatggaccgcatctcatcatcgttcccaatgctgttctggtgaattggaagagtgaactccatacttggctgccatctgtttcatgcatatattatgttggtacaaaggatcaacgttcaaaattgttctctcaggtaaaatttgaaaaattcaatgtcctcgttacgacttatgagttcattatgtatgatcgatcaaaactctcaaaagttgactggaaatatattataattgatgaagcacaacggatgaaggacagagaatctgttttggcccgagatcttgaccggtatcgctgccagaggagattacttctcactggaacacctttgcagaacgatctgaaagagctttggtcactattgaaccttctccttcctgatgtctttgacaatcgaaaagcatttcatgattggtttgcgcaaccctttcaaaaagaaggtcctgcgcataatatagaagatgactggctggagactgaaaaaaaggtcatagtcattcacagacttcatcaaattttagagccattcatgctcagacgccgtgttgaggatgtggaagggtcacttcctgctaaggtttctgtagtcttacgatgtagaatgtctgctattcagagtgccgtttatgattggattaaagcgactggaactcttagagttgatccagacgatgaaaaacttagggctcaaaagaatccgatataccaagccaagatatatagaactttaaataataggtgcatggagttgaggaaagcctgcaatcatcctttgctcaattatccatatttcaatgacttttccaaagatttcctcgtaaggtcatgtggaaaattgtggattctggacaggatccttataaagctacagaggacaggccatcgtgtattgctcttcagtacaatgactaaacttcttgatatcttggaagagtatctacaatggagaaggcttgtatacagaagaattgatgggactaccagcctagaagatcgggaatcagctattgtggacttcaatgatcctgatacggattgctttatcttcttgcttagtatacgtgcagctggacggggtctcaaccttcagactgctgacacagttgttatatatgatcctgatccaaatcccaagaatgaggaacaagcagttgccagagcccatcgtatagggcagacaagggaagtaaaagtgatttatatggaggcagttgttgaaaaactctccagccatcaaaaggaggacgagcttagaagtggtggttcagtagacctagaggatgacatggctgggaaggaccgatatataggatctatagagggtctcataaggaataatattcaacagtataagattgacatggctgatgaggtcattaatgctggtcgttttgaccaaaggacaactcatgaagagcgacgaatgacattggagactttattgcatgacgaagagagatatcaagaaactgtccatgatgtaccttctctgcatgaggtgaacagaatgattgccagaagcgaggaggaagttgagttatttgatcagatggatgaagaatttgactggacggaggagatgactaatcatgagcaggtgcctaagtggcttcgagctagtaccagagaggtgaatgctactgttgctgatttgtctaagaaaccgtcaaagaacatgttgtctagcagtaacctgattgtacaacctggtggacctggaggtgagagaaaaaggggccggcccaagagcaaaaagattaactacaaggaaattgaagatgacattgcaggttactctgaggaaagctctgaggaaaggaacattgattctgggaatgaagaagagggagatattcgacaatttgatgatgatgaacttactggcgctcttggagatcatcaaaccaacaagggagaatttgatggagagaaccccgtctgtggttatgattatcctccgggttctggtagttataaaaaaaatcctcctcgtgatgatgctggttcgtcaggatcttctccagagagccatagatcgaaagaaatggcatctcctgtttcttcacaaaagtttggctctttgtctgcattggacactaggccaggttctgtctctaaaagactgctggatgacctagaagagggggaaatagcagcatcaggggattctcacatagatctccaacgatcaggaagttgggcccatgaccgtgatgaaggggatgaagaacaggttctgcaacctacgataaaacggaaacggagtattcgtctaagaccccgtcagacggcagaaagagttgacggtagtgagatgcctgcagctcagccattgcaagtggatcgtagctaccgatcaaagttaaggacagttgttgactcgcatagttcaagacaagatcagagtgattcgtcctcgagactaaggagtgtacctgcaaagaaggtagctagtacttccaaactccatgtctcatcaccaaaatctggtagattgaatgctacacagcttaccgtggaggataacgctgaagcttccagagaaacatgggatggaactagtcctattagctcttcaaatgctggtgcaagaatgtcccacatcatacagaaacggtgcaaaatcgtgattagcaagctccagaggagaatcgacaaggaaggtcagcagattgtacctatgctgacaaatttgtggaagagaattcagaatggttatgcagctggaggtgtaaataaccttttggaactacgagagatagaccaccgggtagaaagactagagtatgcaggagttatggaactcgcatctgacgtgcagttaatgctaaggggagcaatgcaattctatgggttttcacatgaggtgagatctgaagcaaagaaggttcacaatctgttctttgatctattaaagatgtctttcccagacacagatttccgggaagcaaggaatgctctttccttttctggctcagccccaactttggtgtctacaccaaccccaagaggagcaggaattagccaaggcaagaggcaaaagttagtaaacgagccggaaaccgagccaagctctcctcagagatctcaacaacgtgagaactcaaggatcagagtacagataccgcagaaagaaacaaagcttggggggacaacaagccacactgatgaatccccaatattagctcatccaggggaattagtaatctgcaagaaaaagaggaaagaccgagagaagtctggtccgaaaacccgaactggtggctccagcagcccagtttcaccacctccagcaatgattggtcgtggtcttagaagtcctgtgtctggtggagttccaagggaaacaaggctagcacaacagcagcggtggccaaaccaacccactcatccaaacaacagcggtgcggccggtgattctgtgggatgggcaaatccggtgaagaggttaaggacagattctggtaaaagacggcctagccatttatag

SEQ ID NO: 24 - protein, 2193 aa, Arabidopsis thaliana
MQSGGSGGGPARNPAMGPAGRTASTSSAASPSSSSSSVQQQQQQQQQQQQQQQLASRQQQQQHRNSDTNENMFAYQPGGVQGMMGGGNFASSPGSMQMPQQSRNFFESPQQQQQQQQQGSSTQEGQQNFNPMQQAYIQFAMQAQHQKAQQQARMGMVGSSSVGKDQDARMGMLNMQDLNPSSQPQASSSKPSGDQFARGERQTESSSQQRNETKSHPQQQVGTGQLMPGNMIRPMQAPQAQQLVNNMGNNQLAFAQQWQAMQAWARERNIDLSHPANASQMAHILQARMAAQQKAGEGNVASQSPSIPISSQPASSSVVPGENSPHANSASDISGQSGSAKARHALSTGSFASTSSPRMVNPAMNPFSGQGRENPMYPRHLVQPTNGMPSGNPLQTSANETPVLDQNASTKKSLGPAEHLQMQQPRQLNTPTPNLVAPSDTGPLSNSSLQSGQGTQQAQQRSGFTKQQLHVLKAQILAFRRLKKGEGSLPPELLQAISPPPLELQTQRQISPAIGKVQDRSSDKTGEDQARSLECGKESQAAASSNGPIFSKEEDNVGDTEVALTTGHSQLFQNLGKEATSTDVATKEEQQTDVFPVKSDQGADSSTQKNPRSDSTADKGKAVASDGSQSKVPPQANSPQPPKDTASARKYYGPLFDFPFFTRKLDSYGSATANANNNLTLAYDIKDLICEEGAEFLSKKRTDSLKKINGLLAKNLERKRIRPDLVLRLQIEEKKLRLSDLQSRVREEVDRQQQEIMSMPDRPYRKFVRLCERQRLEMNRQVLANQKAVREKQLKTIFQWRKKLLEAHWAIRDARTARNRGVAKYHEKMLREFSKRKDDGRNKRMEALKNNDVERYREMLLEQQTNMPGDAAERYAVLSSFLTQTEDYLHKLGGKITATKNQQEVEEAANAAAVAARLQGLSEEEVRAAATCAREEVVIRNRFTEMNAPKENSSVNKYYTLAHAVNEVVVRQPSMLQAGTLRDYQLVGLQWMLSLYNNKLNGILADEMGLGKTVQVMALIAYLMEFKGNYGPHLIIVPNAVLVNWKSELHTWLPSVSCIYYVGTKDQRSKLFSQEVCAMKFNVLVTTYEFIMYDRSKLSKVDWKYIIIDEAQRMKDRESVLARDLDRYRCQRRLLLTGTPLQNDLKELWSLLNLLLPDVFDNRKAFHDWFAQPFQKEGPAHNIEDDWLETEKKVIVIHRLHQILEPFMLRRRVEDVEGSLPAKVSVVLRCRMSAIQSAVYDWIKATGTLRVDPDDEKLRAQKNPIYQAKIYRTLNNRCMELRKACNHPLLNYPYFNDFSKDFLVRSCGKLWILDRILIKLQRTGHRVLLFSTMTKLLDILEEYLQWRRLVYRRIDGTTSLEDRESAIVDFNDPDTDCFIFLLSIRAAGRGLNLQTADTVVIYDPDPNPKNEEQAVARAHRIGQTREVKVIYMEAVVEKLSSHQKEDELRSGGSVDLEDDMAGKDRYIGSIEGLIRNNIQQYKIDMADEVINAGRFDQRTTHEERRMTLETLLHDEERYQETVHDVPSLHEVNRMIARSEEEVELFDQMDEEFDWTEEMTNHEQVPKWLRASTREVNATVADLSKKPSKNMLSSSNLIVQPGGPGGERKRGRPKSKKINYKEIEDDIAGYSEESSEERNIDSGNEEEGDIRQFDDDELTGALGDHQTNKGEFDGENPVCGYDYPPGSGSYKKNPPRDDAGSSGSSPESHRSKEMASPVSSQKFGSLSALDTRPGSVSKRLLDDLEEGEIAASGDSHIDLQRSGSWAHDRDEGDEEQVLQPTIKRKRSIRLRPRQTAERVDGSEMPAAQPLQVDRSYRSKLRTVVDSHSSRQDQSDSSSRLRSVPAKKVASTSKLHVSSPKSGRLNATQLTVEDNAEASRETWDGTSPISSSNAGARMSHIIQKRCKIVISKLQRRIDKEGQQIVPMLTNLWKRIQNGYAAGGVNNLLELREIDHRVERLEYAGVMELASDVQLMLRGAMQFYGFSHEVRSEAKKVHNLFFDLLKMSFPDTDFREARNALSFSGSAPTLVSTPTPRGAGISQGKRQKLVNEPETEPSSPQRSQQRENSRIRVQIPQKETKLGGTTSHTDESPILAHPGELVICKKKRKDREKSGPKTRTGGSSSPVSPPPAMIGRGLRSPVSGGVPRETRLAQQQRWPNQPTHPNNSGAAGDSVGWANPVKRLRTDSGKRRPSHL

SEQ ID NO: 25 - DNA, 2330 bp, Arabidopsis thaliana
gctttcattctttggatgcgctgttgtcaacttgtccctcgctgcctctgcttcttaactctttctttatcacttttccactcccaaatcaatttttaggttttttttataattataatttatttgctctcggcaggatctatataatacacagaccagtctttgcgtgtgcttgtgtgcattcattgatcgggtttatatcttttcatcggattttctttgtcgagcaagagccatgtcactgagacccaacgctaagacggaggttcgccggaaccgatacaaagttgcagtggatgcggaggaaggacgacggaggagagaagacaacatggttgagatccgtaaaagcaagcgtgaggagagtttgatgaagaagagacgtgaaggtatgcaagctcttcagggtttcccttcagcttccgccgcctccgtcgataagaagttggatagtctgaaggatatggtcgctggggtttggtccgatgaccctgccttgcagcttgagtccactactcagttcaggaagcttctctctattgagagaagtcctccaatcgaggaagtgataagtgctggtgttgttcctaggtttgttgagtttcttaagaaagaagattaccccgccattcagtttgaggcagcttgggctctaacaaacattgcatctggaacatcggatcacactaaggttgtaatcgatcacaatgctgttccaatctttgttcagcttcttgcttcccctagcgatgatgttcgtgaacaggctgtatgggctttgggtaacgttgctggtgattcaccacggtgccgtgatcttgttcttggatgtggggcactgcttccgctgctcaatcagcttaatgagcatgctaaattgtccatgcttcgaaatgccacttggaccttgtcaaacttctgtcgtggcaagcctcagcctcactttgaccaggtcaaacctgctcttcccgcccttgaacgactaattcattcagatgatgaagaagtcttgacagatgcctgttgggctctttcttacctctctgatgggaccaatgacaaaatccagactgtcatccaggccggtgttgtcccaaaacttgttgaacttctcctccatcattctccatctgtgctaattcctgctcttcgcactgttggaaatatagttactggagatgatatacaaacacagtgcgtgatcaatagtggtgctctaccttgtcttgccaacctgctcactcaaaaccataagaaaagcataaagaaggaagcttgctggacgatttcaaacatcacagcaggcaacaaagatcagatccagacggtagttgaggctaatttgatttccccgttggtgagtctgcttcaaaatgctgaatttgacattaagaaggaagctgcatgggcaatttcaaatgcaacttcaggtggttctcatgatcaaataaaatacctggtggagcaagggtgcataaaaccattatgcgatctcctggtttgcccagatccaagaatcataactgtctgccttgaaggattggaaaacattttgaaggtgggagaggcagagaagaacttgggtcacacaggagacatgaactattacgctcagctgattgatgatgcagaagggctagaaaagatcgagaaccttcagagccatgacaacaatgagatctatgagaaggctgttaaaattctggagacatactggcttgaagaggaagatgatgagacacagcaacctccaggtgttgatggttctcaggctgggttccagtttggagggaatcaagctccagtaccatccggaggattcaacttcagctgaaggtaaataaaagaatggaattggaagcttgcaacttgagaatggtgaaaggtcagagtcagtcagagtctagtttcactgccatggttatactccaggtctggtctggtctggtctcagaggtttgtaccgggtggtcggtttaaaagtacagcgtctgagaaagtgtttggttcattgtccagggctatttttttgaaatgactggtacaccggtcgtgagtcgacctttgtgttgtttttaaattttggagggttataaaaacttacagtggagtcttttgtttttgtgttgacaacagtttgtatgtcggttaaaaaattgaaaccataaaccctttattggtcttaatatgtttggtgtctgatttcctaaggaaaggtttttttttttttggtcaaacctaaggaagggtttatcttcgagttataaagactcgaatctttatttgaattatgaagtaaagtatacataaaacagcaataaattattatg

SEQ ID NO: 26 - protein, 532 aa, Arabidopsis thaliana
MSLRPNAKTEVRRNRYKVAVDAEEGRRRREDNMVEIRKSKREESLMKKRREGMQALQGFPSASAASVDKKLDSLKDMVAGVWSDDPALQLESTTQFRKLLSIERSPPIEEVISAGVVPRFVEFLKKEDYPAIQFEAAWALTNIASGTSDHTKVVIDHNAVPIFVQLLASPSDDVREQAVWALGNVAGDSPRCRDLVLGCGALLPLLNQLNEHAKLSMLRNATWTLSNFCRGKPQPHFDQVKPALPALERLIHSDDEEVLTDACWALSYLSDGTNDKIQTVIQAGVVPKLVELLLHHSPSVLIPALRTVGNIVTGDDIQTQCVINSGALPCLANLLTQNHKKSIKKEACWTISNITAGNKDQIQTVVEANLISPLVSLLQNAEFDIKKEAAWAISNATSGGSHDQIKYLVEQGCIKPLCDLLVCPDPRIITVCLEGLENILKVGEAEKNLGHTGDMNYYAQLIDDAEGLEKIENLQSHDNNEIYEKAVKILETYWLEEEDDETQQPPGVDGSQAGFQFGGNQAPVPSGGFNFS

SEQ ID NO: 27 - DNA, 1563 bp, Arabidopsis thaliana
ctagctcatctgttttcacactctctcctagggttttatctgcgaagcccaatctagagcttccatggcgacgcataccatttctcgatccattctttgccgaccggcgaaatctctttcgtttctgttcacgcgatcctttgcttcatctgctcctctcgccaaatctccggcgtcttctctgctcagccggtcccgtcctctggtcgccgctttttcctccgttttccgtggcggccttgtgtctgtcaaaggtctctcgacgcaggctacatcgtcttctctgaacgacccgaatcccaactggtcgaacaggccacctaaggagacgatcctgctcgatggttgcgatttcgagcactggcttgtcgtcgtggagccacctcagggtgagcctactagagatgaaatcattgatagctacatcaaaaccctagctcagattgttggcagtgaagacgaagctaggatgaagatctactcggtttcaactaggtgctactatgcttttggggcacttgtgtcagaagatctttctcacaagttaaaagagttgtcaaatgtgcgctgggttcttcctgactcttacctggatgtgaggaacaaagactatggaggggaacctttcatcgatgggaaggctgttccttatgatcctaagtaccacgaggagtggataaggaacaatgctagagcaaatgaaaggaacagacgcaatgaccgtcctcgcaacaatgatagaagcagaaactttgagaggagaagagagaacatggcaggaggccctcctcctcaacgtcctcccatgggaggccctcctcctcctccgcacatcggtggctctgcacctcctccgcctcatatgggtggctctgcacctcctccacctcacatggggcagaactatggaccaccaccaccaaacaacatgggaggaccaaggcatccaccaccttatggagcaccaccgcaaaacaacatgggaggaccgaggccacctcagaactatggaggaacaccacctcccaactatggaggagcaccaccagcaaacaacatgggaggagcaccaccaccaaactatggaggaggaccaccacctcaatatggagcagtaccaccacctcaatacggaggagcacccccacagaacaacaactaccagcagcagggtagtggaatgcagcagccacagtaccagaacaactacccacctaaccgggatggcagtggcaacccctaccagggttaaagcagttgaagcagtcgtgggtttcctttttaatcatgcattctgggctgtgtatagataatttgaggaagagagagtgcagtagcaagactttaaaactccttttatctcgagtgtttatcagtctgggattatgtgagagagaatagcctaagttactgtggcatggttagaacttttcactcttgcgtttctttttagtagtttatatcctaaatcgatctcaagttcttccttgtgatgcttgctactcttatgtccactcctggttctgcattaaacgggatttagtaacatgtctcccacaggct

SEQ ID NO: 28 - protein, 395 aa, Arabidopsis thaliana
MATHTISRSILCRPAKSLSFLFTRSFASSAPLAKSPASSLLSRSRPLVAAFSSVFRGGLVSVKGLSTQATSSSLNDPNPNWSNRPPKETILLDGCDFEHWLVVVEPPQGEPTRDEIIDSYIKTLAQIVGSEDEARMKIYSVSTRCYYAFGALVSEDLSHKLKELSNVRWVLPDSYLDVRNKDYGGEPFIDGKAVPYDPKYHEEWIRNNARANERNRRNDRPRNNDRSRNFERRRENMAGGPPPQRPPMGGPPPPPHIGGSAPPPPHMGGSAPPPPHMGQNYGPPPPNNMGGPRHPPPYGAPPQNNMGGPRPPQNYGGTPPPNYGGAPPANNMGGAPPPNYGGGPPPQYGAVPPPQYGGAPPQNNNYQQQGSGMQQPQYQNNYPPNRDGSGNPYQG

SEQ ID NO: 29 - DNA, 1761 bp, Arabidopsis thaliana
ttcgtcttcgattttctctctcaacgcaaactcgtaagctgcttccattttcccttctagaccattgatttgttcttcgaaaaaaccgttctttcttttgcctctcactctagttccttctctcatttctacttctctagcttcactgacttgctgctaccactaaatcttggcatttgtggaaagttgggaatttagggtttttgggtgtgtgtgtgaaaacaatggaagcactagttgttgatgctggctctaagttcctgaaagcaggagcagcaattcctgaccagtctcctgcaatgataattccctctcaaatgaaacgaatggttgatgatgggtcttcttcagctgataaccccaccactgtctttgaggatgtcactcttgatcctattgaaaggggtttgattagagattgggatgctatggaagatctgttgcgttatgttgtctacactgggcttggatgggaagagggaaacgaaggcaatatactttttacagatccactttgtactcctaaggctattagggagcaattggtgcagttgatgtttgaaacattcaatgtctctggattttatgcatctgagcaagcagtgttgtccctttatgctgttggacgcatctccggttgcactgttgatattggtcatgggaagatagatattgccccagttcttgaaggtgcagtacaacacattgcctcgaaacggtttgagctaggtggaaccgagctaactaaattatttgcccaagagcttggaaaaaccaacccgtcgatgaatctcagcatgtctgatgttgaaaaactcaaggagcagtatgcaaactgtgccgaggacgaaattgcttacaaaaaaacccaaaactgtgaaatcgagcagcatactcttcctgatggacaggtgataagcatcgggcgagagagatactcggttggagaagctctgtttcagccatcaatactgggactggaggagcatggaatcgttgagcagcttgtccggattatctccacagtgtcatctgagaaccataggcagctcttggagaacactgtactttgtggtggtacaacctccatgacaggattcgaaagtagattccagaaagaagcaaacttgtgctcatctgccattaggccaacactggtgaaaccgccagaatatatgccggagaatttggggatgtattcggcttgggttggaggagccatactagctaaagtggtgtttccgcagaatcagcacgttactaaagcagattatgacgagactggaccatcagtggttcacaggaaatgtttctgaaaccatagactataaaacgatgttgttgttgtagctgaggattttttttttggttggctttggtttgaagatgtggaccagattatgtagtacatttcaaattatggcttccaaatatcgactaatatgtgttcaatgagcccttttctgaaaacattgacaaggtaactttgccaatgccaacacacacccattgtcagtggaactctaaatggttttgcagatatgtaaccagtgaaactcttggttttgatgcagagaatggccaagatcctctttttcattttgttttgagatctttagtacttgtacaatcaaataacacagtccctttttgttttgttggtgttgtttgctgaaattcgagaaggaaagggtcagtgttaatgtctaaacagaattcaattttttttattttgtaaattggttgcctctttaccttgtt

SEQ ID NO: 30 - protein, 363 aa, Arabidopsis thaliana
MEALVVDAGSKFLKAGAAIPDQSPAMIIPSQMKRMVDDGSSSADNPTTVFEDVTLDPIERGLIRDWDAMEDLLRYVVYTGLGWEEGNEGNILFTDPLCTPKAIREQLVQLMFETFNVSGFYASEQAVLSLYAVGRISGCTVDIGHGKIDIAPVLEGAVQHIASKRFELGGTELTKLFAQELGKTNPSMNLSMSDVEKLKEQYANCAEDEIAYKKTQNCEIEQHTLPDGQVISIGRERYSVGEALFQPSILGLEEHGIVEQLVRIISTVSSENHRQLLENTVLCGGTTSMTGFESRFQKEANLCSSAIRPTLVKPPEYMPENLGMYSAWVGGAILAKVVFPQNQHVTKADYDETGPSVVHRKCF

SEQ ID NO: 31 - DNA, 2338 bp, Arabidopsis thaliana
ccaaaatgtttttgtaaaccaacgaaattcaatctttctctctgtgccttttttcctcttttctcgttcccctctacttcatttagggtttatcatcctctaccaatccgccgattctatacatacacttttcatatatatacatacatcgtctccactctcgttggctcatttttcattcaccgccacgaagcaagaggagattcgtattagccaccatgtctttgagacctaacgctaagactgaggttcgccggaaccgctacaaagtggcggtggatgctgaggaaggaagacggaggagagaggacaacatggtcgagatccgtaagagtaagcgtgaagaaagcttacagaagaagcgtcgtgaaggccttcaagctaatcagctacctcaattcgctccttctcctgttcctgcttcatcaactgttgagaagaagttggagagtttgcctgctatggttggtggtgtttggtcagatgatagaagtttacagcttgaagcgactactcagttccggaaattgctttctattgagcgtagtcctccgattgaagaagtgattgatgctggtgttgtgcctcggtttgtggaatttctcactagagaggattatccacagcttcagtttgaggctgcttgggcattgacaaacattgcttctgggacttcagagaatacaaaggtggtcattgaacatggtgctgttccgatttttgttcaactattggcttctcagagtgatgatgtccgtgagcaggctgtgtgggcattagggaatgttgctggtgattctccacggtgcagagatcttgtccttggtcaaggagctttgataccattactctctcagttgaatgagcatgctaaactctcgatgctgagaaatgctacttggaccctctctaatttctgcaggggcaagccacagcctccctttgaccaggtccgtccagcactcccagcccttgaacgcctgattcattcgactgatgaggaagtgttaacggatgcatgttgggctctctcttacctttccgatggcacaaatgacaaaatccaatctgtcattgaggcaggtgttgttcctcgactcgtcgagcttctccagcatcaatcaccatctgtgcttattcctgcccttcgtagtattggtaacattgtcactggagatgatctgcagacacagtgtgtaattagtcatggtgcacttcttagccttttgagccttctgactcacaatcataagaagagcatcaaaaaggaagcttgctggacaatctcaaatatcactgctggaaacagggaccagattcaggctgtgtgtgaagctggtttgatttgccctcttgtcaatctgcttcaaaatgcggagtttgatataaagaaagaagctgcgtgggcaatatcaaatgccacttcaggtggttctcctgaccaaatcaagtacatggtggaacagggagtcgtgaaaccactgtgtgatcttttggtgtgccctgatccaaggattatcactgtgtgtctggaaggattggagaacattttgaaagttggggaagctgaaaaggtcacaggaaataccggggatgtaaacttttatgcacagctgatcgatgatgctgagggattagaaaagattgagaatctgcagagtcatgacaacagcgaaatctatgagaaggcagtgaagattcttgaaacgtactggttggaagaggaagatgaaactttaccacctggtgatccctctgcacaaggcttccagtttggaggaggtaatgatgcagccgtaccaccaggtggattcaacttccagtgaaggtaaaaaaacctcactacttgggactaatttatctaagcatctaaggctagactagcaaacagagtaaatctgcctgtgtgtctaccttgtgtgaatctgtgagtctggttttgcttccacaggagctgaacatgacgatttgaagagtcgaaggagcttaaagagtttgggggcactggttaaaaagggtatgattagagagtctggtcttctgtgtaaaagtcagatggggtgccttacttagtctggcctggtccggtcagatccagtggttggtgggtttgagtcatggaataagcttgttgggggggagttgggtaggagtcatcaagggatatttatttttgggaaagggtttataagtttttaaagtgtgatctgatgagaatgtgtctctctgggtttttgttacatttgtactacacaacactgcaaagtcaaacataaaaaagttggtcaaactttatttggtcttattggtgacataaaagcccaattggttcgtctct

SEQ ID NO: 32 - protein, 535 aa, Arabidopsis thaliana
MSLRPNAKTEVRRNRYKVAVDAEEGRRRREDNMVEIRKSKREESLQKKRREGLQANQLPQFAPSPVPASSTVEKKLESLPAMVGGVWSDDRSLQLEATTQFRKLLSIERSPPIEEVIDAGVVPRFVEFLTREDYPQLQFEAAWALTNIASGTSENTKVVIEHGAVPIFVQLLASQSDDVREQAVWALGNVAGDSPRCRDLVLGQGALIPLLSQLNEHAKLSMLRNATWTLSNFCRGKPQPPFDQVRPALPALERLIHSTDEEVLTDACWALSYLSDGTNDKIQSVIEAGVVPRLVELLQHQSPSVLIPALRSIGNIVTGDDLQTQCVISHGALLSLLSLLTHNHKKSIKKEACWTISNITAGNRDQIQAVCEAGLICPLVNLLQNAEFDIKKEAAWAISNATSGGSPDQIKYMVEQGVVKPLCDLLVCPDPRIITVCLEGLENILKVGEAEKVTGNTGDVNFYAQLIDDAEGLEKIENLQSHDNSEIYEKAVKILETYWLEEEDETLPPGDPSAQGFQFGGGNDAAVPPGGFNFQ

SEQ ID NO: 33 - DNA, 6499 bp, Arabidopsis thaliana
gtcagtttgaattttccgtagtagatgaacgtgcgattaggtaacagttgaggtctgacggccaggttttcttgtcaccgaatggagggaggaataaactcatggattatgatgacagtgactttcaaaaccagaatctccatttagctggtgaagccaacaacaaatttccaccagttttacagccttatgctcttccaaagtttgattttgatgatacactcaacacgcatctgaggtttgatagtttaggtgaatctgaagcttttcttggtattgagggtaacgaagataataactggattgaggatttctctcgtggaagtagtggtatagtgtttagttcaggtgcaacggagtcctgtgccatttctaggcacaataatgtttggtctgaggctacttcgtcggaatctgttgcaatgcttttgaattcagttggacaggacgaagttattgtaagagaggatactatcaagaaatctgacacttctcatgaactaggctgcacaatggaaacagtagagcctggtcagacatcccatgaaagaagtctttccaaagaggaaacggtgaacttacaacccaacccctctgtggatgatactccaggagagtcctctgtggtaaagacagatgatggacaggagcaggttctggttaaagatgactcaccaacggctgtagaagaggcatctgtggaggaaaagaattccatcttgacttctaataccgcgacggtagaggctatagatactactgatcttggtaaaataggaactgagacgacggataatcttcttgaccaaacagaagagaaagccaatgtagaatcaaggatggaagatgattgtagcgatgggaatgtacagactattattacttgtagcggtgagttgaataatcagagcactttacttccagagacttccaatgatgaaaatgttatcagcgaccacattcaaagtagttataaccgcaatgatctaactgcagatgcacggtcaattttggttgaaggtcattctgatagccatatagactcagcttccgaagttgaaaaagtggaagctgaaaatattggcaaaactgcaaagcctgatttgaaggagatagagctatctgatgtcacagtactagaaagaggggaccaagctccctctactcttgaggtaggtggacaagatgtttctgggaccgaatgccaagatctccttgtcagcactgttcatactagcgtagctgttgaagcgtctttggaacttgctggggaattgacaactataacaaacagtgtttccattgagaagcccgagttgcttagtcatcaacatatggaagttattacaagtgaacatgagtctacttttcagatagagactgagacatatccgcagatacacgtatttgaaacttcagagagtgtttatatttcaacgatggactcaatggttgaagctagagaaggtggtgtgtctaagaagagtgacaatgaaggtagtgctcgcacttctaatctcgagcaaagcatggaactgcctgtcaatgccaatgatagagatcaagatgtcaagaactctcagatcctatctgaaagcgttgtgtctggttctgttggctatgtttcaggaggctctacttcagagttggcggagtcagaatctcaatctgacagcattccaacagacaagtcagagactatgattgacagttctctcaatctcgaagaattacaacctctaagtcaagatggagcacctgctgtcagtctcacatcttcaatagatttacatatggtaaagacatcctctgatgacagtgaccaaggcagttactctgaaaccaagaaggtttatggtgaacctgaaaatggtcaaaccgttccacctgtggatgcaagttgttcagggagtcagatggaccaagaagctaggaagcgtgctgaaggtactaagcaaagtacatactctgttgaaggctgtcctcgctctgaagggtcaaaggatgcagtagatgctgatggtgttggacaagttttgcagcagcagtctgaggaattaatttttgaagagaatgtagtaacagaagctgtaaaagctcctgagactctgtcagttctggacaaggataacaaaaatgaaatgcctattactagctccttgcctattcttgggagtgaagctggaaaagatggccaggaagaggataatactgctgcttctggtgggattatggcagctgggactcctgttacacaccccaaaggtgatgcaatcgtactaggagactcccgtgcttctacatgttctgagtcttctgtaaagtcttatgtaactgcaatagaagatgctgctactaatttaaagactcctcttgattctttccccactgttaagacttccgaacttcaatttaataacacagagacaaacagtgtcaaaaagccagaagatcagaatatttcgggttttatgtctgctggatctccggtcttgaatagaaatgagacctccagcagtgaaatgaacttaactcctgatcagctgaaagcagggaaaatttccaaagctgttatattttcacaagctacccttgtctccccgattgtggtgggatctccttcaacatctagcttagataaaacagctgcaaagtcttccaaagcaaaatctgagcggaaacccaggcgaacatctaaatctgtaggaaaagagacttctagaaaaggaactagtgtaaaaggggctacacctattgaacagtttcaaagtggaggcaaaacaaatgctgttaatcaaagtttggcttctcatattcagatcacacaatctactgagaaacagcgaagtcttcagagccctgctctaaaagcttttgggtccctttcaacccctacggcaagtctaccggatttgaactcttctgctctctcaagtattctgcgtcgacctttcacggacttgcaacaagtgcaactacgtgcacagatttttgtatacggggctctgatccaaggaacagcaccggatgaagcttatatgatatctgcatttggtggtgcagatggtgggaagggcagctgggagaaatcatggcgtacttgtgttgtaagggctcagaaatcgcttgttgctactcctgaaacgccactgcaatcacgtccagggaagacagagaccccttcagcaggtcacaccaatagcaaagagagttcagggacaaaccccatgattccactctcatcacctttatggagtttatcaacttccgtagatactttacaatcaagtagcgttcagagaggttcagctgctactcaccagccattgctttctgcatcgcatgctcaccaaactccaccaactcagaatattgttggacataataccccttggatgtcgcctctccctttccgtaacgcttggcttgcttctcagcaaaccagtggatttgatgttggttcccgtttccccgtctatccaatcactgaccctgtaaaattgactcccatgaaagaatcatccatgactctttctggcgcaaaacatgttcagagtggaacttctagcaatgtttccaaagtgacaccaacacttgagcctactagtacagttgtagcacctgctcaacattctacaagggtaaaatcaaggaaacggaagaagatgccagtctctgtggagtctggtccaaacattttgaattcgttaaagcagacagaattagctgcctcacctcttgtgccttttacacctactccggctaatctgggttataatgctggcaccctgcccagtgttgtttctatgactgcagtccctatggacctggtatctacgttccccgggaagaaaataaaatcatctttcccatctccaatttttggtggtaaccttgtacgtgaagtaaagcagagatctgtcttgtcagaggatactattgaaaaacttaaggaggctaagatgcatgcagaggatgcatctgctcttgctactgcagctgttagtcatagcgaatatgtatggaagcagatagagcaacaaagtcatgctggcctccagccagaaactcaagacagattagcttcggctgctgttgccatagctgctgcagctgcggtggcaaaagctgcagctgctgccgccaatgttgcagctaatgctgcattgcaggccaagttaatggctgaagaagcatcccttccaaatgcttctgatcagggactcccaaagtcatatgatagcatattacccggtcagggtacccctgcttctatcttgaagggtgaaggtgcagtggtgaactccagttcggttcttattgctgcgagagaggcatctaagaagagggttgaagctgctacagcggccaccaagcgtgctgaaaatatggactccattgtaaaagcagcagaattggcatcagaggctgtttctcaagctggaatacttgtttcaatgggtcatcctccgttgctcaataagctggtggaggcgggtccaagtaattactggaggcaggctcaagaatctcaggaagtacagccctgtaaaacggttgtcttagaaaaagaaactgtgtctactagtgagggaacttttgctggtcccaaaattgtgcagactgagtttggtggctctgtgaatacggcagatggtgtgtccggtccagttcctgccactggaaagttaaagggacaggagggtgataaatatgcagacttggctaaaaacaatgatgtggtttttgaaccagaagttgggtcaaaattttcaattgacgcccaacagactatcaaagcaacaaagaatgaggacatcaaggagggttctaatgtagaggttttcaaagaagaacctggattaagaaccgcatggtactctgccaatgtattgagcttagaggatgataaagcttacgtgttgttcagtgacctatctgtagaacaaggaacagacaagcttaaggagtgggtagccctcaaaggggaaggtgatcaggcccctaaaataagacctgctcgttctgttactgccttgccatatgaaggaaccaggaagagacgtagagctgctcttggggatcatatttggaaaattggggatagggtagactcgtgggtgcatgacagttggttggagggtgttatcacagagaagaacaagaaagatgaaaacacagtgactgtgcattttcctgcggaagaagaaactttgacgatcaaagcttggaatcttcgtccttctcttgtgtggaaagatggaaagtggattgaatgttctagttcaggagaaactatcagctcgtcacatgagggtgatactccaaaggagaagcgtcctagattaggaactcccgctcttgtggctgaagtaaaagacacgagtatgaagattgttgatgatccagacttggggaaaccgcctcagactggtgttcttaacctcggtgtttcagagaatacttttaacattggaaagagtaccagagaggagaacaaacccgatccactccgaatgaagagaaccggtttgcaaaagcaaggatcaaaagtgatttttggtgtccctaaacctggaaagaaaaggaagttcatggacgtgagcaaacactatgtttcagaggcaagcactaaaactcaggaaaggaaggaaccagttaagcctgtgagatcaattgtgccccaaaattctggaataggtagctggaaaatgccttctaaaactatctccatagagaaacagacaacaatatctaggcccaagactttcaaacctgcgcccaagcccaaagagaaaccgggtgctacggctaggataattccccgcaaggactcgcgtaatacaacagcatcagatatggaatctgatgagagtgcagaaaacaggggtcctggatctggtgtttcatttaagggaacagtagaagagcaaaccacatcatcctctcatgatactggttcgaagaatagttcctccttgagcactaataaagggagagtggctcctactgcaggaaggttagccaaaatcgaagaggacaaggcgttggctgaaaattcttcaaaaacatcagagggaatggagccacgtagatctatccgcaggatccagccaacttctagactactcgaaggtctgcaaacgtcgatgatgacctcgaagattccttcggtatcacacagcaaaagtcacctaagtcaaagcaaaaagtagcagtagaggcaagtgaaaaggagcagaagaagcaagtgcacataaacgcaagtggaggaaacaaaagcagagcagtatcggctgctattaggttgtttgtaattttagtttcatgcttttgaaaaaaataactctttgttggttgggagagactaaaaaaagtaggggaagagaagaagaaaaatctacatatatatttttggtagactttttggccaaaaatccgttaactatttactaataacatttaggtccttacaaattatatctcaaccaaatattct

SEQ ID NO: 34 - protein, 2037 aa, Arabidopsis thaliana
MDYDDSDFQNQNLHLAGEANNKFPPVLQPYALPKFDFDDTLNTHLRFDSLGESEAFLGIEGNEDNNWIEDFSRGSSGIVFSSGATESCAISRHNNVWSEATSSESVAMLLNSVGQDEVIVREDTIKKSDTSHELGCTMETVEPGQTSHERSLSKEETVNLQPNPSVDDTPGESSVVKTDDGQEQVLVKDDSPTAVEEASVEEKNSILTSNTATVEAIDTTDLGKIGTETTDNLLDQTEEKANVESRMEDDCSDGNVQTIITCSGELNNQSTLLPETSNDENVISDHIQSSYNRNDLTADARSILVEGHSDSHIDSASEVEKVEAENIGKTAKPDLKEIELSDVTVLERGDQAPSTLEVGGQDVSGTECQDLLVSTVHTSVAVEASLELAGELTTITNSVSIEKPELLSHQHMEVITSEHESTFQIETETYPQIHVFETSESVYISTMDSMVEAREGGVSKKSDNEGSARTSNLEQSMELPVNANDRDQDVKNSQILSESVVSGSVGYVSGGSTSELAESESQSDSIPTDKSETMIDSSLNLEELQPLSQDGAPAVSLTSSIDLHMVKTSSDDSDQGSYSETKKVYGEPENGQTVPPVDASCSGSQMDQEARKRAEGTKQSTYSVEGCPRSEGSKDAVDADGVGQVLQQQSEELIFEENVVTEAVKAPETLSVLDKDNKNEMPITSSLPILGSEAGKDGQEEDNTAASGGIMAAGTPVTHPKGDAIVLGDSRASTCSESSVKSYVTAIEDAATNLKTPLDSFPTVKTSELQFNNTETNSVKKPEDQNISGFMSAGSPVLNRNETSSSEMNLTPDQLKAGKISKAVIFSQATLVSPIVVGSPSTSSLDKTAAKSSKAKSERKPRRTSKSVGKETSRKGTSVKGATPIEQFQSGGKTNAVNQSLASHIQITQSTEKQRSLQSPALKAFGSLSTPTASLPDLNSSALSSILRRPFTDLQQVQLRAQIFVYGALIQGTAPDEAYMISAFGGADGGKGSWEKSWRTCVVRAQKSLVATPETPLQSRPGKTETPSAGHTNSKESSGTNPMIPLSSPLWSLSTSVDTLQSSSVQRGSAATHQPLLSASHAHQTPPTQNIVGHNTPWMSPLPFRNAWLASQQTSGFDVGSRFPVYPITDPVKLTPMKESSMTLSGAKHVQSGTSSNVSKVTPTLEPTSTVVAPAQHSTRVKSRKRKKMPVSVESGPNILNSLKQTELAASPLVPFTPTPANLGYNAGTLPSVVSMTAVPMDLVSTFPGKKIKSSFPSPIFGGNLVREVKQRSVLSEDTIEKLKEAKMHAEDASALATAAVSHSEYVWKQIEQQSHAGLQPETQDRLASAAVAIAAAAAVAKAAAAAANVAANAALQAKLMAEEASLPNASDQGLPKSYDSILPGQGTPASILKGEGAVVNSSSVLIAAREASKKRVEAATAATKRAENMDSIVKAAELASEAVSQAGILVSMGHPPLLNKLVEAGPSNYWRQAQESQEVQPCKTVVLEKETVSTSEGTFAGPKIVQTEFGGSVNTADGVSGPVPATGKLKGQEGDKYADLAKNNDVVFEPEVGSKFSIDAQQTIKATKNEDIKEGSNVEVFKEEPGLRTAWYSANVLSLEDDKAYVLFSDLSVEQGTDKLKEWVALKGEGDQAPKIRPARSVTALPYEGTRKRRRAALGDHIWKIGDRVDSWVHDSWLEGVITEKNKKDENTVTVHFPAEEETLTIKAWNLRPSLVWKDGKWIECSSSGETISSSHEGDTPKEKRPRLGTPALVAEVKDTSMKIVDDPDLGKPPQTGVLNLGVSENTFNIGKSTREENKPDPLRMKRTGLQKQGSKVIFGVPKPGKKRKFMDVSKHYVSEASTKTQERKEPVKPVRSIVPQNSGIGSWKMPSKTISIEKQTTISRPKTFKPAPKPKEKPGATARIIPRKDSRNTTASDMESDESAENRGPGSGVSFKGTVEEQTTSSSHDTGSKNSSSLSTNKGRVAPTAGRLAKIEEDKALAENSSKTSEGMEPRRSIRRIQPTSRLLEGLQTSMMTSKIPSVSHSKSHLSQSKK

SEQ ID NO: 35 - DNA, 4075 bp, Arabidopsis thaliana
atggcttttcaaatgccctttacaacaatatcaagaaagatatcatgtatgaagttgttgcctctttgccctcttcagttgtcaacaacgcaaacacctacaacaattcccatgtctctttccttctataagaatgaactttctgatgatacaccttgtcaaagtgggtacactgattacatatcttttcaagtccccgatgagaccttcccagagatttcaaactgtattggcatagctaagggttataagcagaattccaacaatgagaaaaatggttatacttctctggaagccgttttgttatctgtacctaatggctacacttgtgttgatttgtctctctacaaggataaagaactggttttattattgaataagacaaatacagattccgaaggctcgggagaagcatgcatgatggttgtacaaactggtgacctcgcattcatttccatttcaggatctagttctctaaaccagtgggagctagaggatttgaaggtattgctaatttcaagcattaacatcgacggctcgattgtgaacctggaaatggagaatgaaaaggttcgcaaagtaccacattctgtcattgctcctctagcagtaagcgcttcaagaggagtggcttgtgtttttgctgaaagaagacgagctttggtgtacatattggaagaagatgaagatgaagaaatctctgatgaaaactcaactaaggaagcaagacgaaattctctctctttctctaagctctacgccaccgtcacggaggttgtcttgttttgtctcatggagaatgatcaattcatgtgtccgactgatataatcaccggcatagtgtttattgatggtgaattggctatgttgactttgactgccgacggggagttacggtggacagagtatggactccggcagtatttgtcgatgaagaaggatgttcttggtttcatcgtcgaaggtaagcagattagagtaaaagccgtggttgagaaagaggcaggaggaatctgctgcggacaatttggtggagacttcgtgaggaaagatttcgtctttgagcctctcatcgatcaaaatggatggtgctataagcttcgtcaataccttgattctctcggtcggccaaagagattgcttgtgtttgtgaacccgtttggcgggaagaaatcggcgagagagatttttgttaaggaagtgaagcctttgtttgaagatgctgatgttcaacttgagattcaagaaactaagtatcagttgcatgcaaaggaatttgttaagtccatggatgtgtcaaaatatgatggtattgtttgtgtcagcggcgacggtatccttgttgaggttgtaaatggactgctcgaaagagcagactggagaaatgccttaaaattgcctattggaatggtccctgcaggaactggtaatggcatgataaagtcattgttggacacagttgggcttcgatgctgtgcaaatagtgctaccatttctattatccgaggtcataaacgttctgtagatgttgctacaattgcacaagggaataccaaattcttcagtgtcttgatgcttgcttggggtttaatagctgatatagacatcgagtcagagaagttcagatggatgggaagtgctcgtattgacttttatgtatgtttagttgacaaatttgacaattattgcattgcagttgttaaattgctggctcttcagaggataatatgtttaagacgatacaatggacgaattttatttctaccggctcctgggtttgaaggctatggacagccagccagttgcagtctataccaagagccacatgttagtgataaagaggtcgggtaccaaggacctgaaactaaatttgaagatctagaatggagggaaatgaaaggcccatttgttacgatatggcttcacaatgttccctggggttctgagaacactttgactgctcctgctgcaaagttttctgatggctacctggacttgattgtcttgaaaaactgccctaagcttgtcctgctctcacttatgagacagacgagtagtggaacacatgttgagtcaccatatatagtgtatataaagcttactgtcgaaaaggtgaaggcatttgtgctggagccgggtgcacttgtagacgaaccagacaaggaaggaatcatagattcagatggagaggttttggcaagaggaaaaagaacatataaatgtgatcaaaaggccttgatgtcttacgacaagcttcaagtaacagttgatcaagaaagattgttctgtaaattttgtataagccagagggagctagtacttgctaagctctcaccaacgacgaaactcgtctccctccatcttgctatggatcgtcagccggagagggagaatgatgaactaccatctccggcgataatttccgaccgagttctggtaaatggtgttgtcacgccgttaacgttgaccgccgagggagagctacgatcgacggaatctggacggcggaaatcgacgttggcaaaagaaatcctgagtttcgtcgtggaaggtaacaaggttagagtaaagaccttggttgagaaaggaggaggaatttgctgtagaggaagtgctggagattatgcgaggaacgatttcgttttcgagcctctctctgatgaatctagaaagctttggtccgataagttccatcaacacctcgtctctctcggtcggccaaagaaattgcttgtgtttgtgaatccgtttggcgggaagaaaacagcgagaaagatatttcaagaggaagtaaagccattgtttgaagatgcaaatattcaacttgagattcaagaaaccaagtatcagttgcatgcaaaggaaattgttaggtccatggatgtatcaaaatacgatggtattgtttgtgttagcggtgacggtatccttgttgaggttgtaaatggactgcttgaaagagaagactggaagactgccataaaattgccgatcggaatggtccctgcaggaagtggtaatggcatgattaaatcattgttggaaccggtagggcttccttgtagtgcaacaagtgctactatttcgataatccgaggtcgtacacgttctctagatgtagcaactatctcacaagggactaccaaattcttcagtgtcttgatgcttgcttggggtttagtggctgatatagacatcgagtcagagaaattcagatggatgggtagtgctcgctttgatatctatggtcttcagaggataatatgcttaagacaataccatggacgaattctatttgtgccagctcctgggttcgaaagctatgggcaacgagccagttgcagtatagataaagagccatctggtagtgataagacactcgtataccaaggacctgatagtaaacttgaaaatctggattggagagaaatgaaaggcccatttgtttcagtatggcttcataatgttccctggggtgctgagaacactttggctgctcctgacgctaagttttctgatggcttcctggatttgattgtcatgaaagactgtcctaaactagccttgctatcacttatgacaaagttgagtgatggaacccatgtccaatcaccatatgcatcatatctgaaggtgaaggcattcgtactggagccaggtgcacgcatagacgaaccagacaaggaaggaatcatagattcagatggagaagttttggcaagaggaagaaaatcgtacaaatgtgatcaaaaggctttgatgtcttacgacaagcttcaaataagtgttgatcaaggtttagccactctcttctctcctgaataattctgactgatacatgagatgtgatgagatgagatgaagttgtcccttgtggctataatttgattgatggacattacaatacaaaaaatgagaagatgattcgagttatatagtaaatccctaaagattaccattgagtgtattgtttattgttgtattgctgttgtattgcagttttgagttttttgttagaaagttgtgtgaactaagatattgagaagaccataaatactaaatgtgagattttttt

SEQ ID NO: 36 - protein, 1274 aa, Arabidopsis thaliana
MAFQMPFTTISRKISCMKLLPLCPLQLSTTQTPTTIPMSLSFYKNELSDDTPCQSGYTDYISFQVPDETFPEISNCIGIAKGYKQNSNNEKNGYTSLEAVLLSVPNGYTCVDLSLYKDKELVLLLNKTNTDSEGSGEACMMVVQTGDLAFISISGSSSLNQWELEDLKVLLISSINIDGSIVNLEMENEKVRKVPHSVIAPLAVSASRGVACVFAERRRALVYILEEDEDEEISDENSTKEARRNSLSFSKLYATVTEVVLFCLMENDQFMCPTDIITGIVFIDGELAMLTLTADGELRWTEYGLRQYLSMKKDVLGFIVEGKQIRVKAVVEKEAGGICCGQFGGDFVRKDFVFEPLIDQNGWCYKLRQYLDSLGRPKRLLVFVNPFGGKKSAREIFVKEVKPLFEDADVQLEIQETKYQLHAKEFVKSMDVSKYDGIVCVSGDGILVEVVNGLLERADWRNALKLPIGMVPAGTGNGMIKSLLDTVGLRCCANSATISIIRGHKRSVDVATIAQGNTKFFSVLMLAWGLIADIDIESEKFRWMGSARIDFYVCLVDKFDNYCIAVVKLLALQRIICLRRYNGRILFLPAPGFEGYGQPASCSLYQEPHVSDKEVGYQGPETKFEDLEWREMKGPFVTIWLHNVPWGSENTLTAPAAKFSDGYLDLIVLKNCPKLVLLSLMRQTSSGTHVESPYIVYIKLTVEKVKAFVLEPGALVDEPDKEGIIDSDGEVLARGKRTYKCDQKALMSYDKLQVTVDQERLFCKFCISQRELVLAKLSPTTKLVSLHLAMDRQPERENDELPSPAIISDRVLVNGVVTPLTLTAEGELRSTESGRRKSTLAKEILSFVVEGNKVRVKTLVEKGGGICCRGSAGDYARNDFVFEPLSDESRKLWSDKFHQHLVSLGRPKKLLVFVNPFGGKKTARKIFQEEVKPLFEDANIQLEIQETKYQLHAKEIVRSMDVSKYDGIVCVSGDGILVEVVNGLLEREDWKTAIKLPIGMVPAGSGNGMIKSLLEPVGLPCSATSATISIIRGRTRSLDVATISQGTTKFFSVLMLAWGLVADIDIESEKFRWMGSARFDIYGLQRIICLRQYHGRILFVPAPGFESYGQRASCSIDKEPSGSDKTLVYQGPDSKLENLDWREMKGPFVSVWLHNVPWGAENTLAAPDAKFSDGFLDLIVMKDCPKLALLSLMTKLSDGTHVQSPYASYLKVKAFVLEPGARIDEPDKEGIIDSDGEVLARGRKSYKCDQKALMSYDKLQISVDQGLATLFSPE

SEQ ID NO: 37 - DNA, 2428 bp, Arabidopsis thaliana
atagcttttttagaaggaatactgatagagagaaagaaaaatggcaaggccacgactgcttgtagtgtcgatgtcgcttccggtcactgcaaagaggactggagaagagtcttggtctttcacgatgagtcctggtggtctagttagtgctcttctaggtttgaaagaatttgagaccaaatggattggatggcctggagtagatgttcatgatgcgattggcaaaaagacactctccattaccctagctgaaaagggatgtatcccagtgtttttggaagaagtgtgtgatcaatactataatggctactgcaacaatattctgtggccgatttttcactacttgggaacgccaccagaatatcgtaacgatgcaaccataacataccagtcacagtatgaagcatacaagaaagcaaatcaaattttctttgatgttgtcaaagagcactatgaagaaggagatgtggtttggtgccatgattatcatgttatgcttcttcctcaatatcttaaggaatacaacagtaagatgaaagttggatggtttctccatacaccatttccttcttccgagatgtacaaaacattgccctcgcgatccgatctgcttcgttctgttcttactgctgatttagttggtttccatacctatgacttcgcaagacattttttgaatgcatgcatgtgtattcttggagtcgaagcaacatctgaaggaattgtggatcagggcaaagtcactcgagtagctgtttttcccattgggatagaacctgagaggtttataaacacaagtgaactctctgaagttgttcaatacatgaagaagttcaaaaacgattttggtgggagaaagttgatattaggtgttgatcgtctcgatacgatcaaagggattccacaaaaatatcaggcatttgagaagttcttagaggaaaatgcagagtggcgtggtaaagtcatgttacttcagattgcagtgccaacaaggaacggtattggtgaatatcaaaagatcaaagaccaatgtcattaccatgttggacgaattaatggtcgttttggttccatctcttctgttccaataattcacctggattgttctattgactttaatcaattatgcgcactttatgccatcacagatgtattacttgtaacatctctgagagatggaatgaaccttgtgagttctgaattcattgcctgccaaaaagcagaaaaaggggttctcattctaagcgagtttgcaggtgctggacagtcacttggtgccggagctattttagtgaatccttggaacattaaagaagtttcttctgccattggagaagctctaaatatgtcacatgaagaaaaggagagaaaacataaaatcaattttcagtatgtgaaaactcactccactcagcagtgggcagatgatttcatgaaattgactcttacaaacattttatgcagtaaacttattgagattacaaccagcgcggagctaggagctggattagccgccacacttgaacttccagaacatgatgtgattcaacaatactcaaagtctaacaatagactgctgattcttggattctatggaacgctcactcagccgatgaaaaatcaagagagaagaggcgacggaatgaatcttgaactgcatccacagctaaaagagagactcaaagaattatgcagtgatccaaaaacaacagtagttgtcctgagtagaagtgaaaaatgcatattggataaaaactttggagaatataacatgtggttggctgctgaaaatgggatgtttctaaggcatacaagtggagaatgggtgacaagaattccagaacacatgaatttggaatggattgatggtgttaagcatgttttcaagtacttcactgaaagaactccaggatcatatctcgaaacaagcgaggcttcgcttgtatggaactacgaaaatgcagatgctgaattcgggagagctcaagcaagagacatgttacaacacttgtgggcaggaccaatctctaatgcctcagtggatgttgttagaggaggccaatctgttgaagtccatgccgttggtgtgacaaagggaagtgcaatggagcgtattctcggagaaatagtgcataacaagtcaatggctacaccaattgactatgtcttgtgcattggttgtttcttggggaaagacgaagacgtttacacattcttcgagccagagttgaccaagaaagccaagtcgctttcttcttcaggtagtgactcccccaagaaggtatcatcgaccattgttgacctcaagggagagaattacttctccgtagctattggacaaacgcacacaaaggctcgctatttccttgactcatctgatgacgttgtgaaacttattggcaagctttgcacacacaacaatgcttga

SEQ ID NO: 38 - protein, 795 aa, Arabidopsis thaliana
MARPRLLVVSMSLPVTAKRTGEESWSFTMSPGGLVSALLGLKEFETKWIGWPGVDVHDAIGKKTLSITLAEKGCIPVFLEEVCDQYYNGYCNNILWPIFHYLGTPPEYRNDATITYQSQYEAYKKANQIFFDVVKEHYEEGDVVWCHDYHVMLLPQYLKEYNSKMKVGWFLHTPFPSSEMYKTLPSRSDLLRSVLTADLVGFHTYDFARHFLNACMCILGVEATSEGIVDQGKVTRVAVFPIGIEPERFINTSELSEVVQYMKKFKNDFGGRKLILGVDRLDTIKGIPQKYQAFEKFLEENAEWRGKVMLLQIAVPTRNGIGEYQKIKDQCHYHVGRINGRFGSISSVPIIHLDCSIDFNQLCALYAITDVLLVTSLRDGMNLVSSEFIACQKAEKGVLILSEFAGAGQSLGAGAILVNPWNIKEVSSAIGEALNMSHEEKERKHKINFQYVKTHSTQQWADDFMKLTLTNILCSKLIEITTSAELGAGLAATLELPEHDVIQQYSKSNNRLLILGFYGTLTQPMKNQERRGDGMNLELHPQLKERLKELCSDPKTTVVVLSRSEKCILDKNFGEYNMWLAAENGMFLRHTSGEWVTRIPEHMNLEWIDGVKHVFKYFTERTPGSYLETSEASLVWNYENADAEFGRAQARDMLQHLWAGPISNASVDVVRGGQSVEVHAVGVTKGSAMERILGEIVHNKSMATPIDYVLCIGCFLGKDEDVYTFFEPELTKKAKSLSSSGSDSPKKVSSTIVDLKGENYFSVAIGQTHTKARYFLDSSDDVVKLIGKLCTHNNA

SEQ ID NO: 39 - DNA, 1239 bp, Arabidopsis thaliana
ataacataaattaagttttttttgtccttttctgcctttacctttccttctactcccgaaaaagcactgactttgctctgtttccttcgttcacacagagaaagagagaaatcttctgagcgaaattctgacaaaagagatgatggaatgggataatcagctacaacccaataaccatcactcttctaatcttcaagggatcgacgttaatggcggctccggcgccggaggaggaatgtacgtgaaggtgatgaccgatgagcagtatgaaactctcaggaaacagattgctatttacggcaccatttgtgagcgtcttgttgagatgcataaaactctcactgctcaacaagatcttgcaggagggagaatgggaggactatatgcagacccaatgatgtcatctttaggtcataagatgacagctagacagaggtggactcctacgccagtccagcttcagattctggaacgtatattcgatcaaggcacgggaacaccgagcaagcagaagatcaaagacataacagaagagctgagccaacacggccagattgctgaacaaaatgtctataactggttccagaaccgacgtgctcgatccaagaggaagcagcatggtggaggttcttctggaaataataatggtgagtctgaggtagagactgaagttgaagcattgaatgagaagagagtagtgaggccagagagtcttcttggtcttccagatggaaatagcaacaataatgggttagggacaacaacagcaacaactactgctcctaggcctgaagatctttgctttcagagccctgagattagctcagaccttcacttgctagatgttctatcaaacccaagggatgagcatcttgttggaaagatgggactggcggaaagttacaacctttatgatcatgttgaagattatggcatgtcaggctgattgaatacaagctgaggaaacttctaattatcagagagatcaatgaaatggatttggtagtcagtcataagcagtattagacttttgtttttcttaaattgtttctttcagggcttattaaagaaacaagtagtttatcttattaatcattttcagagaaacatttacatggattgttgaatcgtcttgtgatgcttgctttgataatttctgcattcagaacgatttttacatccttaaatgaattatactgtaagaaataaaaaaattccaagagaaaaacatttcaattc

SEQ ID NO: 40 - protein, 268 aa, Arabidopsis thaliana
MMEWDNQLQPNNHHSSNLQGIDVNGGSGAGGGMYVKVMTDEQYETLRKQIAIYGTICERLVEMHKTLTAQQDLAGGRMGGLYADPMMSSLGHKMTARQRWTPTPVQLQILERIFDQGTGTPSKQKIKDITEELSQHGQIAEQNVYNWFQNRRARSKRKQHGGGSSGNNNGESEVETEVEALNEKRVVRPESLLGLPDGNSNNNGLGTTTATTTAPRPEDLCFQSPEISSDLHLLDVLSNPRDEHLVGKMGLAESYNLYDHVEDYGMSG

SEQ ID NO: 41 - DNA, 2141 bp, Arabidopsis thaliana
aaggaagaagaaatgttgttgcgtgtgtgttgtccgtcgtctttcttctacctccgaccgcttcatctcttcagttcaactgcgaaagttcctttttgtccctctcttcccagacaatttcgattaagcccttctcgatcttcttcctttcgtcggatggaatcttctccggcttcttcttcgtctccgacgccggtaaccgattcatctgctgattctttagcgaaagatctgcagaatcaaagtctgggagctgttgatgaaggtgttaagattaaaaagaagctcgaagattttaactgggaccattcctttgttaaggaattgcctggtgatcctagaaccgatgttatctcgcgtgaggtattacatgcttgctattcaaaagtttccccatcagtagaagtggatgatcctcagcttgtagcatggtctgtctctgttgcagagctattagatttggatcctaaagaatttgaaaggccagatttccctctcatgttgtccggcgctaaacctttaccaggagcaatgtcttatgctcaatgctatggaggacaccagtttggcatgtgggctggacaactaggggatggacgtgccattactctgggagaagttttgaactccaaaggtgaaagatgggaacttcagcttaaaggtgcgggtagaactccatatagccgttttgctgatggccttgcagtgctccgtagtagcatcagggagttcctttgcagtgaaactatgcattgtcttgggatccctaccacgcgtgccctttgtcttctcaccacaggtcaaaatgtcactcgcgacatgttttatgatggcaatccgaaggaagaacccggcgcaatcgtttgcagggtttctcagtcatttctacgctttgggtcataccaaatacatgcctctagaggaaaagaggatcttgatattgttcgtaagttggcagactatgccattaaacatcatttcccacatatagagagcatggatagaagcgatagcctatctttcaaaaccggtgatgaagatgattcggttgtggatctaacttccaacaagtatgcagcatggatcgttgaaattgctgagcgtacagctaccttagttgcaagatggcaaggtgtaggtttcacccatggtgtgctcaacactgacaatatgagcattttgggtcaaaccattgactatggcccatttggtttcttggatgcttttgatccaagttacaccccaaacacgacagatctcccaggaagaagatactgttttgcaaatcagcctgacatcggcttgtggaatattgctcaattttctaagactctggcggttgctcaactgataaatcaaaaggaggcgaattacgccatggagaggtacggtgataaattcatggatgagtatcaagccataatgtctaagaagcttggtcttaccaagtataacaaggaggtcattagcaaacttttgaacaatatgtctgttgataaagttgattacaccaacttcttccggcttcttgcaaatgtaaaagcaaatcccaacacacccgaaaatgagttattgaaacccttgaaagctgtgctcttggacatcggaaaggagagaaaagaagcatggatcaaatggatgagaagctatatacaagaggtgggtggtagtgaggtatcagatgaagaaagaaaagcaagaatggattcagtgaacccaaagtacattctgaggaactatctgtgccaaagtgcaatagatgcagctgaacaaggcgatttctcagaagtcaacaatttgatccgtctaatgaaacgtccttatgaggaacagccggggatggagaaatatgctcggttgcctcctgcctgggcttacaggccaggcgtctgcatgctttcttgttcctcctagttcttctccttcctgcttttgttttgccatttatagaaaggaagagaaaaaagtaatactctcttatatgtgtattggctgtaatgctttaaagagacaagaaaaactttgctgttttcaggattttgtttttacattgaataaagatttgagtacatatagatttccatgagaagctcaacaaaagaacccaagagccaatatcattttatgcgattaaaaagatt

SEQ ID NO: 42 - protein, 633 aa, Arabidopsis thaliana
MLLRVCCPSSFFYLRPLHLFSSTAKVPFCPSLPRQFRLSPSRSSSFRRMESSPASSSSPTPVTDSSADSLAKDLQNQSLGAVDEGVKIKKKLEDFNWDHSFVKELPGDPRTDVISREVLHACYSKVSPSVEVDDPQLVAWSVSVAELLDLDPKEFERPDFPLMLSGAKPLPGAMSYAQCYGGHQFGMWAGQLGDGRAITLGEVLNSKGERWELQLKGAGRTPYSRFADGLAVLRSSIREFLCSETMHCLGIPTTRALCLLTTGQNVTRDMFYDGNPKEEPGAIVCRVSQSFLRFGSYQIHASRGKEDLDIVRKLADYAIKHHFPHIESMDRSDSLSFKTGDEDDSVVDLTSNKYAAWIVEIAERTATLVARWQGVGFTHGVLNTDNMSILGQTIDYGPFGFLDAFDPSYTPNTTDLPGRRYCFANQPDIGLWNIAQFSKTLAVAQLINQKEANYAMERYGDKFMDEYQAIMSKKLGLTKYNKEVISKLLNNMSVDKVDYTNFFRLLANVKANPNTPENELLKPLKAVLLDIGKERKEAWIKWMRSYIQEVGGSEVSDEERKARMDSVNPKYILRNYLCQSAIDAAEQGDFSEVNNLIRLMKRPYEEQPGMEKYARLPPAWAYRPGVCMLSCSS

SEQ ID NO: 43 - DNA, 1886 bp, Arabidopsis thaliana
tctctcgagtctcgacaactgagaagcaacggaacaccggtgaatcccggaaagaaggtgaatcaaaaaagcaggctgataggtttatatagcaatgtctggtaacaacaacaatccacaaaagcctcaaggctctgcgcctttgccttttgggaatcctgggatggcctctgcatctgttcctggaaaccaaggttttgctcagtctcatatggcagctaactttcaagctcagtttcagttctctcaagctcaggccctagcccatgctcaagcacagtctaaagttcaagcacaactgcaagctcagttacaagctcaaggcatgacgatgaaccaagcacaaggttctccggggattggtggcttgggtccttcttctccttctttgacgactcctggaagtttaaacatgaagagattccagcagaaaccgccgatgcgacctcctggtgctcctgcgagtaacaacactatctccccaatgagaacaatggagttaactcctgctgctcggaaaaagaaacaaaagcttccagaaaagtcattgcaggagcgggtggctgcaatcttgccagagtctgccttatacacacaacttctggagtttgagtctcgggttgatgctgcgttaactagaaagaaagttgacatccaggaagcccttaaaaaccctccctgcatacagaagactcttaggatctacgttttcaactcgtttgctaaccaaaacaacacgatccctgggaatcctaatgctgacccgccaacatggactcttaaaattattggtaggatactggaagatggggtggatcccgaccagccagggtttgttcagaaagcaaacccattgcatcccaaattctcgtctttcttcaaaagggttacagtttccctggatcagaggctgtatcctgagaacccattgatcatatgggagaatgctcgatcacctgctcctcaggaaggctttgagataaagaggaaagggaatcaggagtttgctgctagtatacggttggagatgaactacgtccctgaaaagttcaagctttctactgcattgatggatgttctcgggattgaggttgaaacccgcccaagaatcatcgctgcaatttggcattacgttaaggcgaggaaactgcagaacccaaatgacccctctttcttcaactgtgatgctgcacttcagaaagtttttggagaagaaaagttgaaattcactatggtctctcagaaaatatctcatcacttgtcgcctccaccacctattcacttagaacacaaaatcaagctctcaggaaataatccggccgtatcagcatgttacgatgtgctagtggatgtacccttcccgatccaaagagatctgaacaatttgctagccaacgcagagaagaacaaagagattgaggcttgtgatgaagcaatatgtgcagccataaggaaaatccatgagcataggaggaggcgggcatttttcttggggttcagccaatcgccagttgaattcataaacgccctgatcgaatctcagagcaaggatctaaaggtcgttgcgggagaagccagtcgaaatgctgagagagaacgtcgatcagacttcttcaaccaaccttgggtcgaagatgcagttatacgttacttgaaccggaggccagcagctgggaacgatgggccagggagttggtgagtttcttgacgatacaagtctcttcatctgtttgagcatttttagtagaagatattgttgagattagtctggtttaaaagtgaactagtgtatctgtaatcttgtgtatgttgaaacattactactttatataattagctttgttttgtagcctttgcgttaatggttaagtcatgtttttattagc

SEQ ID NO: 44 - protein, 534 aa, Arabidopsis thaliana
MSGNNNNPQKPQGSAPLPFGNPGMASASVPGNQGFAQSHMAANFQAQFQFSQAQALAHAQAQSKVQAQLQAQLQAQGMTMNQAQGSPGIGGLGPSSPSLTTPGSLNMKRFQQKPPMRPPGAPASNNTISPMRTMELTPAARKKKQKLPEKSLQERVAAILPESALYTQLLEFESRVDAALTRKKVDIQEALKNPPCIQKTLRIYVFNSFANQNNTIPGNPNADPPTWTLKIIGRILEDGVDPDQPGFVQKANPLHPKFSSFFKRVTVSLDQRLYPENPLIIWENARSPAPQEGFEIKRKGNQEFAASIRLEMNYVPEKFKLSTALMDVLGIEVETRPRIIAAIWHYVKARKLQNPNDPSFFNCDAALQKVFGEEKLKFTMVSQKISHHLSPPPPIHLEHKIKLSGNNPAVSACYDVLVDVPFPIQRDLNNLLANAEKNKEIEACDEAICAAIRKIHEHRRRRAFFLGFSQSPVEFINALIESQSKDLKVVAGEASRNAERERRSDFFNQPWVEDAVIRYLNRRPAAGNDGPGSW

SEQ ID NO: 45 - DNA, 1707 bp, Arabidopsis thaliana
gaaaaaccctagaatcccaaaatagaatccctaaaagagaaagaaagcaaaaatggaggacacgaagccaccattgggaggtaacaacaatcctcagcagcagcagcaacaacaacaacttctctatcaacaccaactacaacaacaacagagacaacaacaaatgcttctattgcagcaattgcaaaaacaacaacagcaacaagcagcaatgtctagattcccgtcgaacatcgacgtgcatctccggccaccggggttgattcagaaccgacccattaatcctccgcctcagcagaatcctacccctaaccctaatttgggacagcagacaccgaattttcaacagcagcagcagcagaatgtatcgagtcagcagatgatgcagcaacaacaacaacagcagcagcagcagaaattgatgaggccattgaatcacatcgagcttcaatgcgcttatcaggacgcttggcgtgtttgtcaccccaattttaaacaacccttctcttctctcgaagatgcttgcgagagattattaccttatcatgtcgtagcagattacgaagcagaagaggatgatagaatccttgattcagacccaacaggccaggccttgtcccgctctcaacaatgggataacaacattgctgcgaaagttgctgaattcacggcaacgtttgagaagcaagcactagcttttaacataataactcgaaagagagctatgggagaattcagatctgaggaaaggttgatggtagaacaagctttgctacaagatgaaaggaaagcgttgattgaactgaaagcagaaatggatagggagaaggctggccgggaggctcaggaggctaagctgcggatggcggctttagctcaagctggacagtctcaatctcatgctgagataatggctcgtaacccattaagggctaatgcggttggaaatcagggcagcaatattcagcttagccacgagatgggagaacagggacgtaacatgaaccctgatgagatgatgaatggatggggaaacaacagtcagagagaggacaaggaaccttcagaagatttcttgaatgatgaggagaatgagaatggagagacaggggaacaagaaaactggcgtgaagcaggagaatttgatttgaatagccggtaaatgaccaaggtgaagactatttgcagtctcatgtattagaaactggaaaggaaattacagttgctcttgatatcactccaatttctatagtttcaagctgctatatatgccaggttcaggtcaagtatatgggtatctgatagtcagactcaaagcctaatgatactcttgctctccgctatctgaattaccaatgatggttccaagtaagcatttcttgtatctgtttgatgttttgtagcataagttagatgtgtgcattacatgttgatgattagtgtcttcatgatacatggagatggagaggctggttacctagtaaccgaatcttgtagaaggtgtaagagatccagatagtaaagcttagtagctaaaatagattatcatatgtaagttactattacagaattgtattggttatgtattggccatgtatggaatgattgattgtgatatgtgaaaagattgtaatagttacacaaatttaatcctcaggtggaggatttttgcatactttctcatcaaattggtctaattttgtttgt

SEQ ID NO: 46 - protein, 369 aa, Arabidopsis thaliana
MEDTKPPLGGNNNPQQQQQQQQLLYQHQLQQQQRQQQMLLLQQLQKQQQQQAAMSRFPSNIDVHLRPPGLIQNRPINPPPQQNPTPNPNLGQQTPNFQQQQQQNVSSQQMMQQQQQQQQQQKLMRPLNHIELQCAYQDAWRVCHPNFKQPFSSLEDACERLLPYHVVADYEAEEDDRILDSDPTGQALSRSQQWDNNIAAKVAEFTATFEKQALAFNIITRKRAMGEFRSEERLMVEQALLQDERKALIELKAEMDREKAGREAQEAKLRMAALAQAGQSQSHAEIMARNPLRANAVGNQGSNIQLSHEMGEQGRNMNPDEMMNGWGNNSQREDKEPSEDFLNDEENENGETGEQENWREAGEFDLNSR

SEQ ID NO: 47 - DNA, 1789 bp, Arabidopsis thaliana
atccgccaaaaacccttcccggaactagaaccctaacttctctgcaagtctctctgttctagtcacaattcactgaattaaagtttgaaaacccatgatgaaatgttgaacctttccaatttccatggcgatttcaagtgtgggttttgcttgcagatccttttcccctgttcgtactctccagtctcactgcttatggaagatacggttcaacactgttgctgctgcaattgagacaatggatgagtcagatggttttgccacggacagtgatcgtcaagacaaggtttctgatgaaccaagggatcgtgagtggaaacaactgaattcgaaagatcttggactaagcagctcaatgattgcaaaatccacaagaaaagtgcttaatggccttaaaagcaaaggacatgatgtttaccttgtgggaggctgtgtacgagatcttattctgaagcggacaccgaaagacttcgatatacttacctctgcagaacttagagaggtggttcgaactttcccaagatgtgaaattgttggaagaaggtttcctatatgtcacgtacacattggagatgatttaatagaggtttcgagttttagtacctctgcacagaattcttcgagaaatacgagaactgaatgcaaagaatcgagtggctcagatggtgatgaggactgtatccgtttgaataactgtttgcagcgtgatttcacaattaacgggttgatgtttgatccatatgccaaagtcgtatatgactatttgggaggaatggaagatattagaaaagctaaagttcgaacagtgattcacgctggcacatcttttcaccaggactgtgctcggattcttcgtgcaataagaattgctgcgcgtttaggtttcagaatgtccaaagaaaccgctcattttattaagaacctttccttactagtacaaagacttgacaagggaaggatcttgatggaaatgaattacatgttagcttatggatcagcagaggcttctttgagattgctgtggaaatttgggatacttgaaattcttctaccaattcaggcagcatatcttgcacgcagtggtttcaggagacgtgacaaaaggactaacatgcttctgtctctctttgctaacttggataaattgttagcacctgataggccttgtcacagcagcttatggatagcaatcttggcgtttcacaaagcacttgctgataaacctcgaagtcctatagtggttgctgcgtttagccttgctgttcacaactgtggagatattctagaagctgtggaaatcacaaagaagatcactaggccacacgataaaagcttcttcgagctagtagagcccgaggagaatctcgacttccaaaccctgttggacgaggtcatggatcttgatgcttctatcgaagatgccttaaaccagatgactgatgcgtattttatatcgaaagctatgtcagcttaccctcaagcaccatattccgatttggtctttataccgttgcagctgtaccttagagcaggcagaatcttcgattgtgtgaaaaacgaagagacacgaattggatttgaggccaagcaaggaagcaagatcgagtatggttcgttaaattcaggatattttcccgaaattcggcatgtatttgcgagggttgtgttcgatactgtttttccattaaacctatctcaagaattgtaaaaatctcatctttgagccctttcaaagcttgggacactaggtggggaaagtatccacaactatccaggctttagttaacag

SEQ ID NO: 48 - protein, 527 aa, Arabidopsis thaliana
MAISSVGFACRSFSPVRTLQSHCLWKIRFNTVAAAIETMDESDGFATDSDRQDKVSDEPRDREWKQLNSKDLGLSSSMIAKSTRKVLNGLKSKGHDVYLVGGCVRDLILKRTPKDFDILTSAELREVVRTFPRCEIVGRRFPICHVHIGDDLIEVSSFSTSAQNSSRNTRTECKESSGSDGDEDCIRLNNCLQRDFTINGLMFDPYAKVVYDYLGGMEDIRKAKVRTVIHAGTSFHQDCARILRAIRIAARLGFRMSKETAHFIKNLSLLVQRLDKGRILMEMNYMLAYGSAEASLRLLWKFGILEILLPIQAAYLARSGFRRRDKRTNMLLSLFANLDKLLAPDRPCHSSLWIAILAFHKALADKPRSPIVVAAFSLAVHNCGDILEAVEITKKITRPHDKSFFELVEPEENLDFQTLLDEVMDLDASIEDALNQMTDAYFISKAMSAYPQAPYSDLVFIPLQLYLRAGRIFDCVKNEETRIGFEAKQGSKIEYGSLNSGYFPEIRHVFARVVFDTVFPLNLSQEL

SEQ ID NO: 49 - DNA, 3811 bp, Arabidopsis thaliana
gctggaactgatttttttcttctctctctctctctctcttccttctgggcttctagggtttgtcctctccagtccccgatttccgctttatccgatcggccgccgccgagattctagataaacctatggcaatggaggttacgcagttgctcattaatgctcagtcgattgatggaactgtacgtaagcacgcggaagaaagtcttaagcagtttcaggagcaaaaccttgcgggtttcttgttgtcgcttgctggagagcttgcgaatgatgagaagccagtagatagcaggaaattagctggtttagtccttaaaaatgctcttgatgctaaggaacaacacaggaagtatgagcttgttcagagatggttggctctagacatgtcaacaaagtcgcagatcagagctttcttgttgaagacactgtcggcacctgtgcctgatgttcgttcgactgcatctcaggtcattgctaaggttgcaggtattgagttaccacagaagcagtggcctgagctcatagtgtctcttctctcaaatattcaccagttacctgctcatgtcaagcaagccactttggagactcttggatacctatgtgaagaagtgtcacctgatgttgttgaacaggagcatgtaaataagatactcacagctgttgttcagggtatgaatgctgctgaaggtaatactgatgttagacttgctgcaacccgtgctttatacatggctctcggattcgcccaagcaaatttcaacaacgacatggagcgtgattatatcatgagagttgtgtgtgaagcaaccctgtcccctgaggtgaaaattaggcaggcagcttttgagtgtttggtatctatcgcttccacatactatgagaagttggcgcattacatgcaagatatattcaacatcacagctaaggctgtaagagaagatgacgagtctgttgctctacaggcaattgagttctggagttctatttgtgacgaagagattgacatcttagaagaatatggtggtgagttcgctggggattctgatgttccatgcttttattttactaagcaggctctccctggtcttgtgcctctactgctggagactcttctgaagcaagaagaagatcaagatttggatgaaggggcttggaatattgcaatggcaggtgggacatgcctcggtttggttgctagggcagttggagatgacattgttccacatgtcatgccgtttattgaagagaaaatatcaaagcctgattggagagagcgagaagctgcaacttatgcttttggttccattttggaaggcccttctgccgataagttgatggcaattgttaacgcagcgttaacatttatgctcaatgctctaacaaatgacccaagcaaccatgtgaaagacacaaccgcatggacccttggtcggatatttgagttccttcatggttcaacaatcgagacacctattattaatcaggcaaactgccagcagataatcacagtactcatccagagcatgaatgatgcgcctaatgttgccgagaaggcttgtggggctctgtacttccttgctcaaggctatgaggatatcggtcccagttctccgttaacacccttcttccaggaaattattaagtcacttttagctgttgcacacagagaggatgcaactgaatcacgcttgcggactgcagcatatgaggcattgaatgaagttgtcaggtgttcaactgatgaaacgtctaccatggttctgcaattagtaccagtgataatgatggagcttcacaatactttggaaggggaaaagctttcattggatgagagggagaaacaaaacgagttgcagggacttctatgtggatgcttgcaggtcatcatacagaaattaggatctgaaccaaccaagtctaagttcatggagtatgcagaccaaatgatgggacttttcctgagggtgtttggttgtagaagtgcaactgcacatgaggaagccatgcttgccattggtgctcttgcttatgcagcaggtcccaattttgccaaatacatgcctgagttttataagtacttggagatgggtcttcaaaactttgaagaataccaagtgtgtgctgttactgttggtgttgttggggatgtctgcagagcattggaggacaagattttaccttattgcgatgggattatgacacagcttctgaaagatttgtcgagcaaccaattgcaccgatcagtgaagccaccgatattctcctgttttggtgacatagcacttgctatcggtgaggattttgataagtactggaggtattcaatgccgatgcttcagagtgccgcagagttatctgctcactcggctggagctgatgatgaaatgacggagtacacaaactcattgagaaacggaatccttgaggcttattcaggcatatttcaaggtttcaagaactccgccaaaacccagctcctgattcctttcgcaccccatatcctccagtttttggacagtatatacatggagaaagacatggacgaggtggtgatgaagacagcgattggggtcttaggagatttagcagatacactagggagtcatgtgggtggtttgatacaacagtcagtgtcaagtaaagagttcttaaacgaatgtttgtcttctgaagaccacacaattaaagaagcagccgaatgggcgaagcatgccataacccgtgccatatctgtttgaaggctcttcttttgcctataagaaagaaaattccttttgctttttagtaaagtctgcatgcatctctgggtgggttgagtcggtcggggggaggggtagagctgcaacatccgagtcacatcagcatcatcagcatcagtttcatttgcatcatcagcataactggggtcagtcagggaatcgttgagtcgtggatgtggggaatgatgagttttggggtaaataatgaaactggaagagtcacgggtgaaagtttcccgggtaaggttaaatccccgggagtagaaagaggaggaagtgagtcatggtcgttttctggtgggttttgggacaaagttataccaaaaaaaaaaaggtttcatggaacatctcataatacattcttgttttttcttttctctcatatgttcttcaaccccttgaggagggagaggtctcaggtttttatcaagtgggggcattattagaggacaatcccttgattttttcttttgttttcttttattatttggttagttgcagtctttgcatcatcattttgtcttttgggggggtttgtatgtttgattaaaagcattattcacatttttatttttatataaagaagtttcacatgtctgtctatcttctctttgctatgatgcagtttagggggttttgcatatatacttgtgttttgtttgcaatcaagtttcaaatgtcacatacaggaacatttttattatatggtgtcatgtcttagggtcttaaagaggtccacatctattcattttactatggaactgtttacaatcgtttagaatccattatttgatttggctcgaactatatgggaaagggcacatgttaataggagaaaacgtcctgccttactctgcttccaaagagtcaagttaagagatcgaagaacatttcacattcacgctgtttatggaaacctcaattttgattgtatgtgttgcttttttttggttttccaaacgccaaatgcaactgataccgaacctatattttgaaaaatgttttcatgtgtatttgaaacattctagaccattcaagttatggtttaaatt

SEQ ID NO: 50 - protein, 870 aa, Arabidopsis thaliana
MAMEVTQLLINAQSIDGTVRKHAEESLKQFQEQNLAGFLLSLAGELANDEKPVDSRKLAGLVLKNALDAKEQHRKYELVQRWLALDMSTKSQIRAFLLKTLSAPVPDVRSTASQVIAKVAGIELPQKQWPELIVSLLSNIHQLPAHVKQATLETLGYLCEEVSPDVVEQEHVNKILTAVVQGMNAAEGNTDVRLAATRALYMALGFAQANFNNDMERDYIMRVVCEATLSPEVKIRQAAFECLVSIASTYYEKLAHYMQDIFNITAKAVREDDESVALQAIEFWSSICDEEIDILEEYGGEFAGDSDVPCFYFTKQALPGLVPLLLETLLKQEEDQDLDEGAWNIAMAGGTCLGLVARAVGDDIVPHVMPFIEEKISKPDWREREAATYAFGSILEGPSADKLMAIVNAALTFMLNALTNDPSNHVKDTTAWTLGRIFEFLHGSTIETPIINQANCQQIITVLIQSMNDAPNVAEKACGALYFLAQGYEDIGPSSPLTPFFQEIIKSLLAVAHREDATESRLRTAAYEALNEVVRCSTDETSTMVLQLVPVIMMELHNTLEGEKLSLDEREKQNELQGLLCGCLQVIIQKLGSEPTKSKFMEYADQMMGLFLRVFGCRSATAHEEAMLAIGALAYAAGPNFAKYMPEFYKYLEMGLQNFEEYQVCAVTVGVVGDVCRALEDKILPYCDGIMTQLLKDLSSNQLHRSVKPPIFSCFGDIALAIGEDFDKYWRYSMPMLQSAAELSAHSAGADDEMTEYTNSLRNGILEAYSGIFQGFKNSAKTQLLIPFAPHILQFLDSIYMEKDMDEVVMKTAIGVLGDLADTLGSHVGGLIQQSVSSKEFLNECLSSEDHTIKEAAEWAKHAITRAISV

SEQ ID NO: 51 - DNA, 860 bp, Arabidopsis thaliana
tcaaaacgcagcgttttctagctgatagataaagcaactattttcccggctagtgagaagagagagaagagaatggaaggtgtaggatcgagattgagccggacgtcatcgagatacagtggtccggcggcgacggcggtgttcagtggccgtgtaaggaaatggaagaagaagtgggtacgtgtctcaacctcatccgtcggtgttttcagagcatctaaatccaacggtcgtaacaacagcaacaacagtaactcaccacaccatctacttctccataagtggactccacttacctcagcgacggttactgcctccgacgctaatggttccggtgagacagaggagtcgcctaagcgaagattcagatacgctccaattgcgatgcttgagcatagagaaaaagtgatttctaaggattctgaaattgaagagactgaagaattcgacactgaatctccattacctaaagctgttgagctagacatgaacctaacagactcagaccaaactaaggaagcaaaaactggtaatttgaatctgggactgtgtctgaattctgaagggactgaagaatgaagagaatcatattgatttgggatgagcaactataaaatgtgttcagctgtgatgatgtcttatattgtatcttatgctaggcggttattccactttgacgtcttctagatctctatgtagtgtgtttgtaagttaggaagaagttatataaatgtaagatttgaagcttttaccaagagtttggctttggcttatgaatttgtgtaaaagttacagaaccagggcttccctggaagtacagagcatagtcatgctaccttatgggaatcttgttcctccaa

SEQ ID NO: 52 - protein, 168 aa, Arabidopsis thaliana
MEGVGSRLSRTSSRYSGPAATAVFSGRVRKWKKKWVRVSTSSVGVFRASKSNGRNNSNNSNSPHHLLLHKWTPLTSATVTASDANGSGETEESPKRRFRYAPIAMLEHREKVISKDSEIEETEEFDTESPLPKAVELDMNLTDSDQTKEAKTGNLNLGLCLNSEGTEE

SEQ ID NO: 53 - DNA, 633 bp, Arabidopsis thaliana
atgcaacagcacctgatgcagatgcagcccatgatggctggttactaccccagcaatgttacctctgatcatatccaacagtacttggacgaaaacaaatcgttgattctgaagattgttgagtctcaaaactctggaaagcttagcgaatgcgccgagaatcaagcaaggcttcaacgcaacctaatgtacctagctgcaatagcagattctcagcctcagccaccaagtgtgcatagccagtatggatctgctggtggtgggatgattcagggagaaggagggtcacactatttgcagcagcaacaagcgactcaacagcaacagatgactcagcagtctctaatggcggctcgatcttcaatgttgtatgctcagcaacagcggcagcagcagccttacgcgacgcttcagcatcagcaatcgcaccatagccagcttggaatgagctcgagcagcggaggaggaggaagcagtggtctccatatccttcagggagaggctggtgggtttcatgattttggccgtgggaagccggaaatgggaagtggtggtggcggtgaaggcagaggaggaagttcaggggatggtggagaaaccctttacttgaaatcatcagatgatgggaattga

SEQ ID NO: 54 - protein, 210 aa, Arabidopsis thaliana
MQQHLMQMQPMMAGYYPSNVTSDHIQQYLDENKSLILKIVESQNSGKLSECAENQARLQRNLMYLAAIADSQPQPPSVHSQYGSAGGGMIQGEGGSHYLQQQQATQQQQMTQQSLMAARSSMLYAQQQRQQQPYATLQHQQSHHSQLGMSSSSGGGGSSGLHILQGEAGGFHDFGRGKPEMGSGGGGEGRGGSSGDGGETLYLKSSDDGN

SEQ ID NO: 55 - DNA, 588 bp, Arabidopsis thaliana
atgcagcagcagcagtctccgcaaatgtttccgatggttccgtcgattccccctgctaacaacatcactaccgaacagatccaaaagtaccttgatgagaacaagaagctgattatggccatcatggaaaaccagaatctcggtaaacttgctgagtgcgcccagtaccaagctcttctccagaagaacttgatgtatcttgctgcaattgctgatgctcaacccccaccacctacgccaggaccttcaccatctacagctgtcgctgcccagatggcaacaccgcattctgggatgcaaccacctagctacttcatgcaacacccacaagcatcccctgcagggattttcgctccaaggggtcctttacagtttggtagcccactccagtttcaggatccgcaacagcagcagcagatacatcagcaagctatgcaaggacacatggggattagaccaatgggtatgaccaacaacgggatgcagcatgcgatgcaacaaccagaaaccggtcttggaggaaacgtggggcttagaggaggaaagcaagatggagcagatggacaaggaaaagatgatggcaagtga

SEQ ID NO: 56 - protein, 195 aa, Arabidopsis thaliana
MQQQQSPQMFPMVPSIPPANNITTEQIQKYLDENKKLIMAIMENQNLGKLAECAQYQALLQKNLMYLAAIADAQPPPPTPGPSPSTAVAAQMATPHSGMQPPSYFMQHPQASPAGIFAPRGPLQFGSPLQFQDPQQQQQIHQQAMQGHMGIRPMGMTNNGMQHAMQQPETGLGGNVGLRGGKQDGADGQGKDDGK

SEQ ID NO: 57 - DNA, 672 bp, Arabidopsis thaliana
atgcagcaatctccacagatgattccgatggttcttccttcatttccgcccaccaataatatcaccaccgaacagatccaaaagtatcttgatgagaacaagaagctgataatggcgatcttggaaaatcagaacctcggtaaacttgcagaatgtgctcagtatcaagctcttctccagaagaatttgatgtatctcgctgcaattgcggatgctcaacctcagccaccagcagctacactaacatcaggagccatgactccccaagcaatggctcctaatccgtcatcaatgcagccaccaccaagctacttcatgcagcaacatcaagctgtgggaatggctcaacaaatacctcctgggattttccctcctagaggtccattgcaatttggtagcccgcatcagtttctggatccgcagcaacagttacatcaacaagctatgcaagggcacatggggattagaccaatgggtttgaataataacaacggactgcaacatcaaatgcaccaccatgaaactgctcttgccgcaaacaatgcgggtcctaacgatgctagtggaggaggtaaaccggatgggaccaatatgagccagagtggagctgatgggcaaggtggctcagccgctagacatggcggtggtgatgcaaaaactgaaggaaaatga

SEQ ID NO: 58 - protein, 223 aa, Arabidopsis thaliana
MQQSPQMIPMVLPSFPPTNNITTEQIQKYLDENKKLIMAILENQNLGKLAECAQYQALLQKNLMYLAAIADAQPQPPAATLTSGAMTPQAMAPNPSSMQPPPSYFMQQHQAVGMAQQIPPGIFPPRGPLQFGSPHQFLDPQQQLHQQAMQGHMGIRPMGLNNNNGLQHQMHHHETALAANNAGPNDASGGGKPDGTNMSQSGADGQGGSAARHGGGDAKTEGK

SEQ ID NO: 59 - DNA, 627 bp, Allium cepa
atgcagcagccgcagccagcgatgggaaccatgggctcggtgccacctactagcatcaccaccgaacagattcaaaggtacttggatgagaacaaacagttaatattggcaattttggataatcaaaatttaggaagactgaatgagtgtgctcaatatcaagctcagcttcaaaagaatctgctttacctggcagcaatagctgatgctcagcctcagtctcctgcggtgcgtctgcagatgatgcctcaaggtgcagctgccacgcctcaagctggaaaccaatttatgcagcagcagagccctaatttccctcccaaaacaggaatgcaatttactcctcaacaagtacaagaattgcagcagcaacagctacaacatcagccacatatgatgcctccatttcaaggtcaaatgggtatgagacctatgaatggaatgcaggcagcaatgcatgcagattcatctcttgcttataacactaacaataagcaagatgcaggaaacgcagcttatgaaaatactgctgccaacacagatggttccattcaaaagaaaacagcaaatgatgatttagacccttctgcagcaaaccctagaaggtctgaagatgccaaatcatcatga

SEQ ID NO: 60 - protein, 208 aa, Allium cepa
MQQPQPAMGTMGSVPPTSITTEQIQRYLDENKQLILAILDNQNLGRLNECAQYQAQLQKNLLYLAAIADAQPQSPAVRLQMMPQGAAATPQAGNQFMQQQSPNFPPKTGMQFTPQQVQELQQQQLQHQPHMMPPFQGQMGMRPMNGMQAAMHADSSLAYNTNNKQDAGNAAYENTAANTDGSIQKKTANDDLDPSAANPRRSEDAKSS

SEQ ID NO: 61 - DNA, 633 bp, Aquilegia formosa x Aquilegia pubescens
atgcaacacatgcagatgcagcccatgatgccaccttatagtgccaacagcgtcactactgatcatatccaacagtacttggatgaaaataaggcgttgattctgaagatacttgagaaccaaaattcgggaaaagttagtgaatgtgcagagaaccaagcaagacttcaacgaaatcttatgtatctggctgcaattgctgattctcaaccacagcctcccaatatgcatgctcagtactctaatgcgggtataccacctggtgcacattacctacaacaccaacaggcccaacagatgacacaacagtcgctcatggctgctcgatcaaatatgctgtatgctcagccaatcacaggaatgcagcaacagcaagcaatgcatagccagcttggcatgagctctggtggtaacagtggactccacatgatgcacaatgagggcagcatgggaggtagtggggcacttggaagctattctgattatggccgtggcagtggtggtggagtaactatcgctagcaaacaagatggtggaagtggttctggtgaaggacgaggtggaaactctggaggccaaagtgcagatggaggtgaatctctttacctgaaaaacagtgacgaagggaactaa

SEQ ID NO: 62 - protein, 210 aa, Aquilegia formosa x Aquilegia pubescens
MQHMQMQPMMPPYSANSVTTDHIQQYLDENKALILKILENQNSGKVSECAENQARLQRNLMYLAAIADSQPQPPNMHAQYSNAGIPPGAHYLQHQQAQQMTQQSLMAARSNMLYAQPITGMQQQQAMHSQLGMSSGGNSGLHMMHNEGSMGGSGALGSYSDYGRGSGGGVTIASKQDGGSGSGEGRGGNSGGQSADGGESLYLKNSDEGN

SEQ ID NO: 63 - DNA, 668 bp, Aquilegia formosa x Aquilegia pubescens
atgcagcaacctccgccaatgatgaacatggtcccaccatttcctcctactaacattacaactgaacagattcaaaagtatctggatgagaacaaaacactgattttggcaatattagacaatcagaatcttggaaaattagccgaatgtgctcagtaccaagctcagcttcagaagaatctgatgtatcttgctgcaattgctgatgcccaaccgcaagctcctgcagttccctctcagatgccaacacatccggcaatgcaacagggaggacattatatgcaacatccgcaagcagctatgcctcaacagcccagtggttttccacccaagtcccccatgcaatttaaccctcagcaaatgcaagagcagcaacggctgcagctacaacagcaacaccaacaggcacttcaaggtcatatgggcattcgacctggagtcaacaatggtttgcaaatgcatggggatggtaatgttggaggcagcagcagcggtggcccatcatcaaccggtaacttacctgatttctcacgcagtggtgccggtcctggtgctggttctagttcattggatgcacgggaaggtaagcaagatggagtggaagcgggtgctggtgatggtcaaggcaattcagcagccagaaataatggttcaaatggggatacatg

SEQ ID NO: 64 - protein, 222 aa, Aquilegia formosa x Aquilegia pubescens
MQQPPPMMNMVPPFPPTNITTEQIQKYLDENKTLILAILDNQNLGKLAECAQYQAQLQKNLMYLAAIADAQPQAPAVPSQMPTHPAMQQGGHYMQHPQAAMPQQPSGFPPKSPMQFNPQQMQEQQRLQLQQQHQQALQGHMGIRPGVNNGLQMHGDGNVGGSSSGGPSSTGNLPDFSRSGAGPGAGSSSLDAREGKQDGVEAGAGDGQGNSAARNNGSNGDT

SEQ ID NO: 65 - DNA, 633 bp, Aspergillus officinalis
atgcagcagcacctgatgcagatgcagcccatgatggcaacctacggttcaccgaatcaggtcaccaccgatatcattcagcagtatctggacgagaacaagcagttgattctggctattcttgaaaaccaaaattcaggaaaagctgatgaatgtgctgagaatcaggctaagcttcagaggaatctgatgtatcttgcagccattgcggatagccagccccaagttcctaccattgctcagtatcctcccaacgctgttgctgctatgcaatcgagtgctcgctacatgcaacaacaccaagcagctcaacagatgacccctcaatctctcatggctgctcgctcctcaatgctctactcacagtccccaatgtctgcactccagcagcaacagcagcaagcagcaatgcatagccagctcgccatgagctccggaggcaacaacagcagcaccggaggattcaccattcttcatggtgaagctagcataggaggcaatggctcaatgaattctggtggagtctttggagattttggacggagcagcggtgggaagcaagagactgggagcgaagggcacgggacagagactcctatgtacctgaaaggctctgaagaagaaggaaactga

SEQ ID NO: 66 - protein, 210 aa, Aspergillus officinalis
MQQHLMQMQPMMATYGSPNQVTTDIIQQYLDENKQLILAILENQNSGKADECAENQAKLQRNLMYLAAIADSQPQVPTIAQYPPNAVAAMQSSARYMQQHQAAQQMTPQSLMAARSSMLYSQSPMSALQQQQQQAAMHSQLAMSSGGNNSSTGGFTILHGEASIGGNGSMNSGGVFGDFGRSSGGKQETGSEGHGTETPMYLKGSEEEGN

SEQ ID NO: 67 - DNA, 558 bp, Beta vulgaris
atgcagcaacaatcacctcaaatgttcaaccacccaccttcacaacccacaattactaccgaacaaattcaaaagtatcttgatgagaacaagcagttgattttggcaattatggaaagtcaaaactctggaaaaatgaatgaatgtgcccagtatcaagctcagctgcagaaaaacttgatgtacttggctgcaattgctgatgctcagccaccagcacctacagggccctctcagtctcagccgcagaattctcagatgcctatgcaatcgaccattccacaaggcccttttatgccgcctcctaaacctgcagttaccccacagcaaacaggtcccagattgccctttgctctacagtcgtttgatcagcagtcaccccatatgcaaatgcaataccaacagtccatggcaggctccatgggtatgagaatgggtgggaataatgttttacgcccttccatccagaccggatatggagctccaacacattttatggatgcacggaacagacaagatggttctgacgcaagtctcggtgatgatcatggaaagtaa

SEQ ID NO: 68 - protein, 185 aa, Beta vulgaris
MQQQSPQMFNHPPSQPTITTEQIQKYLDENKQLILAIMESQNSGKMNECAQYQAQLQKNLMYLAAIADAQPPAPTGPSQSQPQNSQMPMQSTIPQGPFMPPPKPAVTPQQTGPRLPFALQSFDQQSPHMQMQYQQSMAGSMGMRMGGNNVLRPSIQTGYGAPTHFMDARNRQDGSDASLGDDHGK

SEQ ID NO: 69 - DNA, 615 bp, Brachypodium distachyon
atgcagcaggcgatgtccatgtccccggggtcggccggcgcggtgccgcctccggccggcatcaccacagagcagatccaaaagtatttggatgaaaataagcaacttattttggccatcctggaaaatcagaacctaggaaagttgactgaatgtgctcagtatcaagctcaacttcagaagaatctcttgtatctggctgccattgcggatgcccaaccaccacagaaccctggaagtcgcccccagatggtgcagcctggtggtatgccaggtgcagggcattacatgtcgcaagtaccaatgttccctccaagaacccctttaaccccacaacagatgcaagagcaacagcaccagcagcttcagcagcagcaagcacaggctcttgctttccccagccagatggtcatgagaccaggtactgtgaacggcatgcagcctatgcaagctgatctccaagcagcagcagcagcacctggcctggcagacagccgaggaagtaagcaggacgcagcggtagctggggccatctcggaaccttctggcaccgagagtcacaagagtacaggagcggatcatgaggcaggtggcgatgtagctgagcaatcctaa

SEQ ID NO: 70 - protein, 204 aa, Brachypodium distachyon
MQQAMSMSPGSAGAVPPPAGITTEQIQKYLDENKQLILAILENQNLGKLTECAQYQAQLQKNLLYLAAIADAQPPQNPGSRPQMVQPGGMPGAGHYMSQVPMFPPRTPLTPQQMQEQQHQQLQQQQAQALAFPSQMVMRPGTVNGMQPMQADLQAAAAAPGLADSRGSKQDAAVAGAISEPSGTESHKSTGADHEAGGDVAEQS

SEQ ID NO: 71 - DNA, 591 bp, Brassica napus
atgcagcccatgatggctggttactaccccagcaatgtcacctctgatcatatccagcagtacttggatgagaacaagtctttgattctgaagatagttgagtctcaaaactcaggaaagctcagcgagtgtgccgagaatcaggcaaggcttcaacgcaacctcatgtacttggctgcaatagcagattctcagcctcaacctccaagcgtgcatagccagtatggatctgctggtggtgggttgattcagggagaaggagcgtcacactatttgcagcagcaacaggcgactcaacagcagcagatgactcagcagtctcttatggcagctcgttcttcaatgatgtatcagcagcagcaacagccttatgcaacgcttcagcatcagcagttgcaccatagccagcttgggatgagctctagcagcggaggaggaagcagtggtctccatatccttcagggagaggctggtgggtttcatgaatttggccgtgggaagccggagatgggaagtggtgaaggcaggggtggaagctcaggggatggtggagaaacactctacttgaagtcatcagatgatgggaactga

SEQ ID NO: 72 - protein, 203 aa, Brassica napus
MQQHLMQMQPMMAGYYPSNVTSDHIQQYLDENKSLILKIVESQNSGKLSECAENQARLQRNLMYLAAIADSQPQPPSVHSQYGSAGGGLIQGEGASHYLQQQQATQQQQMTQQSLMAARSSMMYQQQQQPYATLQHQQLHHSQLGMSSSSGGGSSGLHILQGEAGGFHEFGRGKPEMGSGEGRGGSSGDGGETLYLKSSDDGN

SEQ ID NO: 73 - DNA, 636 bp, Brassica napus
atgcagcagcagcagcagcagcagcagcagcctccgcaaatgtttccgatggctccttcgatgccgccaactaacatcaccaccgaacagatccaaaagtaccttgaggagaacaagaagctgataatggcaatcatggaaaatcagaatcttggcaagcttgcagagtgtgcacagtaccaagctcttctccagaagaacttaatgtacctcgctgctattgctgatgctcaacctcctccatctaccgctggagctacaccaccaccagctatggcttcccagatgggggcaccgcatcctgggatgcaaccgccgagctactttatgcaacacccacaagcttcagggatggctcaacaagcaccacccgctggtatcttccctccgagaggtcctttgcagtttggtagcccacaccagcttcaggatccgcaacagcagcatatgcatcaacaggctatgcaaggacacatggggatgcgaccaatgggtatcaacaacaacaatgggatgcagcatcagatgcagcaacaacaaccagaaacctctcttggaggaagcgctgcaaacgtggggcttagaggtggaaagcaagatggagcagatggacaaggaaaagatgatggcaaatga

SEQ ID NO: 74 - protein, 203 aa, Brassica napus; identical to SEQ ID NO: 72

SEQ ID NO: 75 - DNA, 552 bp, Chlamydomonas reinhardtii
atggcggcagcctcaaaacctccaccgatgacgaccgacaaaatacaagacatgctggaggagaatttcaagttcattaaagccattgccgagcagcaaaacttgggccgggttcaagaagtgcaccagtaccagcagaagctgcaggagaacctgatgctgctggccgcagtggcagacacctactccaactcagcagcagcagcacagccggggggagaagctggcgcagccgcacccgcggcggccacggcacgaccacccaccgcgcctggagcgccgctgggggcaccgggagcaccgccgcccgcggctccggctctcacaccacagcagatccacgcggccgtgcagcaggcactggccatgaagcagcagcagcagcagcagcagcagcaacagccgcagcagccgcagcagtcggcggtggcgcagtaccagcaaccgcctcaagcggggctgcccataccgggcgggatggcgcccgggcaaggcgcgccgccaggcttcacgctaccggcgccaccgcccctgaacctagccgggcagtag

SEQ ID NO: 76 - protein, 183 aa, Chlamydomonas reinhardtii
MAAASKPPPMTTDKIQDMLEENFKFIKAIAEQQNLGRVQEVHQYQQKLQENLMLLAAVADTYSNSAAAAQPGGEAGAAAPAAATARPPTAPGAPLGAPGAPPPAAPALTPQQIHAAVQQALAMKQQQQQQQQQQPQQPQQSAVAQYQQPPQAGLPIPGGMAPGQGAPPGFTLPAPPPLNLAGQ

SEQ ID NO: 77 - DNA, 663 bp, Citrus sinensis
atgcaacagcacctgatgcagatgcagcccatgatggcagcttattatcccaacaacgtcactactgaccacattcaacagtatctagatgagaacaaatcattgattttgaagattgttgagagccagaattcagggaaactgagcgagtgtgcagagaaccaggcaagattgcagcggaatctcatgtacctggctgctattgctgatgctcaaccccaaccacctagcgttcatgcccagttctcttctggtggcattatgcagccaggagctcactatatgcaacaccagcaatctcagccaatgacaccacagtcacttatggctgcacgctcatccatggtgtactctcaacagcaattttcagtgcttcagcaacagcaagccttgcatggtcagcttggcatgagctctggtggtagctcaggacttcacatgctgcaaagtgagggtagtactgcaggaggtagtggttcacttgggggtgggggattccctgattttggccgtggctcatctggtgaaggcttgcactcaaggggaatggggagcaagcatgatataggcagttctggatctgctgaaggacgaggagggagctcaggaagccaagatggaggcgaaactctctacttgaaaggggctgatgatggaaattaa

SEQ ID NO: 78 - protein, 219 aa, Citrus sinensis
MQQHLMQMQPMMAAYYPNNVTTDHIQQYLDENKSLILKIVESQNSGKLSECAENQARLQRNLMYLAAIADAQPQPPSVHAQFSSGGIMQPGAHYMQHQQSQPMTPQSLMAARSSMVYSQQQFSVLQQQQALHGQLGMSSGGSSGLHMLQSEGSTAGGSGSLGGGGFPDFGRGSSGEGLHSRGMGSKHDIGSSGSAEGRGGSSGSQDGGETLYLKGADDG

SEQ ID NO: 79 - DNA, 636 bp, Citrus sinensis
atgcagcagccaccgcaaatgatccctgttatgccttcatttccacccaccaacatcaccacagagcagattcaaaagtaccttgatgagaacaaaaagttgattttggcaattttggacaatcaaaatcttggaaagcttacagaatgtgcccactatcaagctcagcttcaaaagaatttaatgtatttagctgcaattgctgatgcacaaccacaagcaccaacaatgcctcctcagatggctccacatcctgcaatgcaagctagtgggtattacatgcaacatcctcaggcggcagcaatggctcagcaacaaggaatctttccccaaaagatgccattacaattcaataaccctcatcaactacaggatcctcaacagcagctacaccaacatcaagccatgcaagcacaaatgggaatgagaccgggtgccactaacaatggtatgcatcccatgcatgctgaaagctctcttggaggtggcagcagtggaggacccccttcagcatcaggcccaggtgacatacgtggtggaaataagcaagatgcctcggaggctgggactactggtgctgatggccagggcagttcggctggtgggcatggtggggatggagaggaggcaaagtga

SEQ ID NO: 80 - protein, 211 aa, Citrus sinensis
MQQPPQMIPVMPSFPPTNITTEQIQKYLDENKKLILAILDNQNLGKLTECAHYQAQLQKNLMYLAAIADAQPQAPTMPPQMAPHPAMQASGYYMQHPQAAAMAQQQGIFPQKMPLQFNNPHQLQDPQQQLHQHQAMQAQMGMRPGATNNGMHPMHAESSLGGGSSGGPPSASGPGDIRGGNKQDASEAGTTGADGQGSSAGGHGGDGEEAK

SEQ ID NO: 81 - DNA, 729 bp, Cryptomeria japonica
atgcagcagcatctcatgcaaatgcagccgatgatggcagcagcttacgcttctaacaacattaccactgatcacattcaaaagtacttggatgagaacaagcagttgatattagcaattatggacaatcaaaatctgggaaagcttaatgaatgtgcacagtaccaagcaaaacttcaacagaacttgatgtatctagctgctattgctgattctcagcctcaagttccggctgcacatgctcagattcctcctaatgcggttgtgcagtctggtgggcttttcatgcagcaccagcaagcacagcagcaagttactcctcagtctcttatggcagctagatcttccatgttgtatacccagcagccgatggctgctttgcatcaagcccagcagcagcagcaacaacaatctcttcacagccatcttggtataagttctggaggaagcaatggcttgcacatgttgcatggtgaagcaaacatgggaggtaacgggcctctctcatctggaggcttccctgacttttcacgtggaactggggcctctggtgaaggcattcaggccaataggggcatgtgtatagatcgtggtgcaaataagcatgatggcgctggaacggagaatgctcatccaggcccaggggatgggcgagggagttcgactggaggccagaatacagatgggtcagaacaatcatacctgaaagcctcagaagaggggaactag

SEQ ID NO: 82 - protein, 242 aa, Cryptomeria japonica
MQQHLMQMQPMMAAAYASNNITTDHIQKYLDENKQLILAIMDNQNLGKLNECAQYQAKLQQNLMYLAAIADSQPQVPAAHAQIPPNAVVQSGGLFMQHQQAQQQVTPQSLMAARSSMLYTQQPMAALHQAQQQQQQQSLHSHLGISSGGSNGLHMLHGEANMGGNGPLSSGGFPDFSRGTGASGEGIQANRGMCIDRGANKHDGAGTENAHPGPGDGRGSSTGGQNTDGSEQSYLKASEEGN

SEQ ID NO: 83 - DNA, 651 bp, Curcuma longa
atgcagcaatctccacattcgctagcccccatgtcagcagcccctgttgcgaatattacaacagaacaaattcaaaagtacttggatgagaataagcagctcattttggcaatattggaaaatcagaaccttgggaaattggctgaatgtgctcagtaccaagcgcagcttcagaaaaatctactttatcttgctgcaattgctgatgctcaacctaatgcacctgcagttcgtccccagcagatcatgccacacggtacgataccacagggaagccctttcatgcaacaatcacccatcttccctcgaggtcctcttccatataatcctcaacaaatgcaagggcagctacatccccaacccccaggaatggtgttcccaggccatatgggcattaggcccggcgctgtcaacggcttacatggctcgcatactgaaccatctcatggtggcactgctaatcccctcacaactccaagcttgtctggattcccaccaaccaactcagatggacgtgggagtaagcaagaagccggcatcgccatggtacctgccgtagctgagagccacaggaactcaggaagtgagcctgtcagtggggatgctgatcaatcacatgctaaaagaccagaggatacaaagacaccatga

SEQ ID NO: 84 - protein, 216 aa, Curcuma longa
MQQSPHSLAPMSAAPVANITTEQIQKYLDENKQLILAILENQNLGKLAECAQYQAQLQKNLLYLAAIADAQPNAPAVRPQQIMPHGTIPQGSPFMQQSPIFPRGPLPYNPQQMQGQLHPQPPGMVFPGHMGIRPGAVNGLHGSHTEPSHGGTANPLTTPSLSGFPPTNSDGRGSKQEAGIAMVPAVAESHRNSGSEPVSGDADQSHAKRPEDTKTP

SEQ ID NO: 85 - DNA, 597 bp, Euphorbia esula
atgcagcagcaaccgcagatgatgcctatgatgccttcatatccaccagcaaacattaccacggagcaaatccaaaagtatcttgatgaaaataaaaaattgattttggcgatcttggataatcaaaatcttggaaaactcgctgagtgtgcacagtatcaagccctgctgcaaaaaaatctgatgtatttagccgcaattgctgatgcacaaccccagaccccacccatgccacctcagatgtccccacatccggctatgcaacaaggagcatattacatgcaacatcctcaggctgcagcagcagcaatggctcatcagtcgggtattttcccaccaaagatgtctccgttacaattcaataatcctcatcaaatacaggacccccagcagttacatcaagcagccctccaagggcaaatgggaatgaggcccatggggcccaataacgggatgcatccgatgcaccccgaggcaaatcttggaggatctaatgatggtcgtggaggaaacaaacaggatgctccggagacgggagcatcgggaggtgatgggcaaggcaattctggtggtgatggggctgaagatgggaaatga

SEQ ID NO: 86 - protein, 198 aa, Euphorbia esula
MQQQPQMMPMMPSYPPANITTEQIQKYLDENKKLILAILDNQNLGKLAECAQYQALLQKNLMYLAAIADAQPQTPPMPPQMSPHPAMQQGAYYMQHPQAAAAAMAHQSGIFPPKMSPLQFNNPHQIQDPQQLHQAALQGQMGMRPMGPNNGMHPMHPEANLGGSNDGRGGNKQDAPETGASGGDGQGNSGGDGAEDGK

SEQ ID NO: 87 - DNA, 597 bp, Fragaria vesca
atgcagcagcagccacagcagatgatgcccaacatgacttcgcttcctcccaataccatcaccaccgagcaaattcagaagtgccttgatgagaacaaaaagttgattctagcaatattggacaatcaaaaccttggaaaacttgctgagtgtgcccagtaccaaactcagcttcaaaagaatctcatgtatttagcagcaattgctgatgcacaaccacaaccacaaccacaagcaccagcaatgccggcccagcagctggccccgcatcctgcgatgcaacaagctggatattacatgcagcatcctcaggctgcagcagcaatggctcagcaacagggtcttttccctcaaaagatgcaaatgcagtttaatagcccacaacaaatgcacgagatgcagcagcagttacaccaacaggccatgcatggccagatggggatgagacctggaggggccaatgggatgccttcaatgcatcatactgagaacacccatggaggaagcaagcaagacaactcagaggctggggcaggtggtgatggccaggggaactcagccggtggccacagaagtggcgacggagaggacaagtga

SEQ ID NO: 88 - protein, 198 aa, Fragaria vesca
MQQQPQQMMPNMTSLPPNTITTEQIQKCLDENKKLILAILDNQNLGKLAECAQYQTQLQKNLMYLAAIADAQPQPQPQAPAMPAQQLAPHPAMQQAGYYMQHPQAAAAMAQQQGLFPQKMQMQFNSPQQMHEMQQQLHQQAMHGQMGMRPGGANGMPSMHHTENTHGGSKQDNSEAGAGGDGQGNSAGGHRSGDGEDK

SEQ ID NO: 89 - DNA, 639 bp, Glycine max
atgcagcagcacctgatgcagatgcagcccatgatggctgcctactaccccaacaacgtcaccactgatcacattcaacagtacctggatgagaacaagtccttgattctgaagattgttgaaagccagaattctggcaagctgagcgagtgtgccgagaaccaatcaaggctgcagagaaatctcatgtacctagctgcaatagctgattctcaaccacaaccatctccattggctggtcagtatccttctagtggacttgtgcagcagggagcacactacatgcaggctcaacaggctcagcagatgtcacaacaacagctaatggcttcgcgctcctcgctcctgtactcccaacagcctttctcagtgcttcaacagcagcaaggcatgcacagccaacttggcatgagctccagtggaagtcaaggcctccacatgctgcaaagtgaagccactaatgttggaggcaatgcaaccataggaaccggaggagggtttccggactttgtacgcattggtagtggcaagcaagatattggaatctctggtgaaggcagaggaggaaactctagtggccactctggtgatggtggtgagacacttaattacctgaaagctgctggtgatggaaactga

SEQ ID NO: 90 - protein, 212 aa, Glycine max
MQQHLMQMQPMMAAYYPNNVTTDHIQQYLDENKSLILKIVESQNSGKLSECAENQSRLQRNLMYLAAIADSQPQPSPLAGQYPSSGLVQQGAHYMQAQQAQQMSQQQLMASRSSLLYSQQPFSVLQQQQGMHSQLGMSSSGSQGLHMLQSEATNVGGNATIGTGGGFPDFVRIGSGKQDIGISGEGRGGNSSGHSGDGGETLNYLKAAGDGN

SEQ ID NO: 91 - DNA, 633 bp, Glycine max
atgcagcagcacctgatgcagatgcagcccatgatggcaggctactaccccaacaacgtcaccactgatcacattcagcagtatctggatgagaacaagtccttaattctgaagattgttgaaagccagaattctggcaagctgagcgagtgtgccgagaaccaagcaaggcttcagagaaatctcatgtacttagctgcaatagctgattctcaaccccaaccacccaccatgtctggtcagtaccctccgagtgggatgatgcagcagggagcacagtacatgcaggctcaacaacaggcacagcagatgacaccacaacaactaatggcagcacgctcatctcttttgtacgcacagcagccgtactcagcacttcaacagcagcaagccatgcacagtgcactggggtcgagttcggggctccacatgctgcaaagtgaaggcagcaatgtgaatgtgggaggagggtttcctgactttgtgcgtggcggcagctccacaggggagggtttgcacagtggtggaaggggtatcattggaagtagcaagcaggaaatggggggttcaagtgaaggccgcggtgaagggggtgaaaacctctacctcaaagttgctgatgatggaaactag

SEQ ID NO: 92 - protein, 210 aa, Glycine max
MQQHLMQMQPMMAGYYPNNVTTDHIQQYLDENKSLILKIVESQNSGKLSECAENQARLQRNLMYLAAIADSQPQPPTMSGQYPPSGMMQQGAQYMQAQQQAQQMTPQQLMAARSSLLYAQQPYSALQQQQAMHSALGSSSGLHMLQSEGSNVNVGGGFPDFVRGGSSTGEGLHSGGRGIIGSSKQEMGGSSEGRGEGGENLYLKVADDGN

SEQ ID NO: 93 - DNA, 642 bp, Glycine max
atgcagcagacaccgccaatgattcctatgatgccttctttcccacctacgaacataaccaccgagcagattcaaaaataccttgatgagaacaagaagctgattctggcaatattggacaatcaaaatcttggaaaacttgcagaatgtgcccagtaccaagctcagcttcaaaagaatttgatgtatttagctgcaattgctgatgcccagcctcaaaccccggccatgcctccgcagatggcaccgcaccctgccatgcaaccaggattctatatgcaacatcctcaggctgctgcagcagcaatggctcagcagcagcaaggaatgttcccccagaaaatgccattgcaatttggcaatccacatcaaatgcaggaacaacaacagcagctacaccagcaggccatccaaggtcaaatgggacttagacctggagatataaataatggcatgcatccaatgcacagtgaggctgctcttggaggtggaaacagcggtggtccaccttcggctactggtccaaacgatgcacgtggtggaagcaagcaagatgcctctgaggctggaacagctggtggagacggccaaggcagctccgcggctgctcataacagtggagatggtgaagaggcaaagtga

SEQ ID NO: 94 - protein, 213 aa, Glycine max
MQQTPPMIPMMPSFPPTNITTEQIQKYLDENKKLILAILDNQNLGKLAECAQYQAQLQKNLMYLAAIADAQPQTPAMPPQMAPHPAMQPGFYMQHPQAAAAAMAQQQQGMFPQKMPLQFGNPHQMQEQQQQLHQQAIQGQMGLRPGDINNGMHPMHSEAALGGGNSGGPPSATGPNDARGGSKQDASEAGTAGGDGQGSSAAAHNSGDGEEAK

SEQ ID NO: 95 - DNA, 633 bp, Glycine max
atgcagcagacaccgcctatgattcctatgatgccttcgttcccacctacgaacataaccaccgagcagattcaaaaataccttgatgagaacaagaagctgattctggcaatattggacaatcaaaatcttggaaaacttgcagaatgtgcccagtaccaagctcagcttcaaaagaatttgatgtatttagctgcaattgctgatgcccagcctcaaacaccagccatgcctccacagatggcaccacaccctgccatgcaaccaggattctatatgcaacatcctcaggctgcagcagcagcaatggctcagcagcagcagcaaggaatgttcccccagaaaatgccattgcaatttggcaatccacatcaaatgcaggaacaacagcagcagctacaccagcaagccatccaaggtcaaatgggactgagacctggaggaataaataatggcatgcatccaatgcacaatgagggcggcaacagcggtggtccaccctcggctaccggtccgaacgacgcacgtggtggaagcaagcaagatgcttctgaggctggaacagctggtggagatggccaaggcagctctgcagctgctcataacagtggagatggtgaagaggcaaagtga

SEQ ID NO: 96 - protein, 210 aa, Glycine max
MQQTPPMIPMMPSFPPTNITTEQIQKYLDENKKLILAILDNQNLGKLAECAQYQAQLQKNLMYLAAIADAQPQTPAMPPQMAPHPAMQPGFYMQHPQAAAAAMAQQQQQGMFPQKMPLQFGNPHQMQEQQQQLHQQAIQGQMGLRPGGINNGMHPMHNEGGNSGGPPSATGPNDARGGSKQDASEAGTAGGDGQGSSAAAHNSGDGEEAK

SEQ ID NO: 97 - DNA, 633 bp, Glycine soya; identical to SEQ ID NO: 95

SEQ ID NO: 98 - protein, 210 aa, Glycine soya; identical to SEQ ID NO: 96

SEQ ID NO: 99 - DNA, 660 bp, Gossypium arboreum
  misc_feature (309)..(309): n is a, c, g, or t
atgcagcagcacctgatgcagatgcagcccatgatggcagcttattatcccaacaacgtcactactgatcatattcaacagtatctcgatgagaacaagtcattgatcttaaagattgttgagagccagaattctgggaaattgagtgaatgtgctgagaaccaagcaaggctgcagcgaaacctcatgtacctggctgccattgcggattctcaaccccaaccacccaccgtgcatgcacagtttccatctggtggtatcatgcagcaaggagctgggcactacatgcagcaccaacaagctcaacanatgacacaacagtcgcttatggctgctcggtcctcaatgttgtattctcagcaaccattttctgcactgcaacaacaacaacaacaaggctttgcacagtcagcttggcatgagctctggcgggagcacaggcctttcatatgctgcaaactgaatctagtactgcagggggcagtgagacaccttgggcccgagggttgtcctgatttggacgggggtcttttggagaggcatccctggtggcaggccaatggccgggggaacaaccaaaaatccggggaggccggctcacctaagggccgggaggagcccttggggcaggggggggtgatggggggaacctcttcttaa

SEQ ID NO: 100 - protein, 219 aa, Gossypium arboreum
  UNSURE (103)..(103): Xaa can be any naturally ocurring amino acid
MQQHLMQMQPMMAAYYPNNVTTDHIQQYLDENKSLILKIVESQNSGKLSECAENQARLQRNLMYLAAIADSQPQPPTVHAQFPSGGIMQQGAGHYMQHQQAQXMTQQSLMAARSSMLYSQQPFSALQQQQQQGFAQSAWHELWREHRPFICCKLNLVLQGAVRHLGPEGCPDLDGGLLERHPWWQANGRGNNQKSGEAGSPKGREEPLGQGGVMGGTSS

SEQ ID NO: 101 - DNA, 690 bp, Gossypium hirsutum
atgcagcagcacctgatgcagatgcagcccatgatggcagcttattatcccaacaacgtcactactgatcatattcaacagtatctcgatgagaacaagtcattgatcttaaagattgttgagagccagaattctgggaaattgagtgaatgtgctgagaaccaagcaaggctgcagcgaaacctcatgtacctggctgccattgcggattctcaaccccaaccacccaccgtgcatgcacagtttccatctggtggtatcatgcagccaggagctgggcactacatgcagcaccaacaagctcaacaaatgacacaacagtcgcttatggctgctcggtcctcaatgttgtattctcagcaaccattttctgcactgcaacaacaacagcagcaagctttgcacagtcagcttggcatgagctctggcggaagcacaggccttcatatgctgcaaactgaatctagtactgcaggtggcagtggagcacttggggccggagggtttcctgattttggacgtggttcttctggagaaggcatccatggtggcaggccaatggcaggtggaagcaagcaagatatcgggagtgccggctcagctgaaggtcgtggaggaagctctggtggtcagggtggtggtgatgggggtgaaaccctttacttaaaagcagccgatgatgggaactga

SEQ ID NO: 102 - protein, 229 aa, Gossypium hirsutum
MQQHLMQMQPMMAAYYPNNVTTDHIQQYLDENKSLILKIVESQNSGKLSECAENQARLQRNLMYLAAIADSQPQPPTVHAQFPSGGIMQPGAGHYMQHQQAQQMTQQSLMAARSSMLYSQQPFSALQQQQQQALHSQLGMSSGGSTGLHMLQTESSTAGGSGALGAGGFPDFGRGSSGEGIHGGRPMAGGSKQDIGSAGSAEGRGGSSGGQGGGDGGETLYLKAADDGN

SEQ ID NO: 103 - DNA, 642 bp, Gossypium hirsutum
atgccgcagccaccgcaaatgattcctgtgatgccttcatatccacctactaatatcactactgaacagattcagaagtaccttgatgagaataagaagttgattttggcaattttggacaatcagaatcttggaaaactcgctgaatgcgcccagtatcaagctcagctgcaaaagaatttgatgtatttagctgcaattgcggatgctcaacctcaatcaacgccagcaatgtcgcctcagatggcaccgcatccagcaatgcaacccggaggatattttatgcaacatcctcaagctgctgcaatgtcacagcaacctggcatgtaccctcaaaaggtgccattgcaattcaatagtccgcatcaaatgcaggaccctcagcacctcctatatcagcagcatcaacaagcaatgcaaggtcaaatgggaatcaggcctgggggacccaataatagcatgcatcccatgcattcagaggctagccttggaggcggcagcagtggtggtccccctcaaccttcaggcccaagtgatggacgtgctggaaacaagcaagagggctccgaagctggtggtaatgggcagggcagcacaactggtgggcatggtggcggtgatggagcggatgaggcaaagtga

SEQ ID NO: 104 - protein, 213 aa, Gossypium hirsutum
MPQPPQMIPVMPSYPPTNITTEQIQKYLDENKKLILAILDNQNLGKLAECAQYQAQLQKNLMYLAAIADAQPQSTPAMSPQMAPHPAMQPGGYFMQHPQAAAMSQQPGMYPQKVPLQFNSPHQMQDPQHLLYQQHQQAMQGQMGIRPGGPNNSMHPMHSEASLGGGSSGGPPQPSGPSDGRAGNKQEGSEAGGNGQGSTTGGHGGGDGADEAK

SEQ ID NO: 105 - DNA, 630 bp, Helianthus annuus
atgcagcagcacctgatgcagatgcagcccatgatggcagcctattatcccaccaacaacgtcactactgatcatattcaacagtacttggatgaaaacaagtctctgatcttgaagattgttgagagccaaaactctgggaaaatggctgaatgtgcagaacatcaggccaagcttcagagaaaccttatgtaccttgctgcaattgctgattctcaacctcaagcacctagtcttcactctcagtatcctcaaggtgggatgatgcagcagcaggctggaagtcactacatgcagcagcaccaacaggcacaacagatgtcaccacaagcactcatggctgcacgctcatccatgatgtacagtcagcagcagtactcttcactacagcagcaagcaatgcatagccatctgggcatgagttctggaactggaaccagtggacttcacatgctgcagaccgacaataatagcgcgggtgtcagtgggacccacctaagtggtgggttccccgactttggtcgtaagcaagatattggtcccaccggtgaggggcggggtggtggtagctctggcggtggagacggtggcgagacgctctacttgaagtcgcctgataaaggtaactga

SEQ ID NO: 106 - protein, 209 aa, Helianthus annuus
MQQHLMQMQPMMAAYYPTNNVTTDHIQQYLDENKSLILKIVESQNSGKMAECAEHQAKLQRNLMYLAAIADSQPQAPSLHSQYPQGGMMQQQAGSHYMQQHQQAQQMSPQALMAARSSMMYSQQQYSSLQQQAMHSHLGMSSGTGTSGLHMLQTDNNSAGVSGTHLSGGFPDFGRKQDIGPTGEGRGGGSSGGGDGGETLYLKSPDKGN

SEQ ID NO: 107 - DNA, 561 bp, Hordeum vulgare
atgcagcaagcgatgcccatgccgccggcggcggcggcgcctgggatgcctccttctgccggcctcagcaccgagcagatccaaaagtacctggatgaaaataaacaactaattttggctatcttggaaaatcagaacctgggaaagttggcggaatgtgctcagtatcaagctcagcttcagaagaatcttttgtatttggctgcgattgctgatactcagccacagacctctgtaagccgtcctcagatggcaccacctgctgcatccccaggggcagggcattacatgtcacaggtgccaatgttccctccgaggacccctctaacgcctcagcagatgcaggagcagcaactacagcaacaacaggctcagatgcttccgtttgctggtcaaatggttgcgagacccggggctgtcaatggcattccccaggcccctcaagttgaacaaccagcctatgcagcaggtggggccagttccgagccttctggcaccgagagccacaggagcactggcgccgataacgatggtgggagcggcttggctgaccagtcctaa

SEQ ID NO: 108 - protein, 186 aa, Hordeum vulgare
MQQAMPMPPAAAAPGMPPSAGLSTEQIQKYLDENKQLILAILENQNLGKLAECAQYQAQLQKNLLYLAAIADTQPQTSVSRPQMAPPAASPGAGHYMSQVPMFPPRTPLTPQQMQEQQLQQQQAQMLPFAGQMVARPGAVNGIPQAPQVEQPAYAAGGASSEPSGTESHRSTGADNDGGSGLADQS

SEQ ID NO: 109 - DNA, 555 bp, Lactuca serriola
  misc_feature (253)..(253): n is a, c, g, or t
atgaagcagccgatgatgccgaatccaatgatgtcttcttcgtttcctcctacaaacatcaccaccgatcagatccaaaagttccttgatgaaaacaagcaactaattatagcaataatgagcaacctaaatcttggaaagcttgctgaatgtgcccagtaccaagctctactccaaaaaaatttgatgtatctagcagccattgcagatgctcaaccacctacacctacaccaacactaaatatctcttatnagatgggcccggttccacatccagggatgccacagcaaggtggattttacatggcgcagcagcaccctcaggcggctgtaatgacggctcagccaccttctggttttccacaaccgatgcctggtatgcaatttaacagcccacaggctattcaagggcagatgggcgggaggtccggtgggccgccaagctcagccgctagtgatgtctggagaggaagcatgcaagatggtggtggtggtgctgctgctgatggtggtaaggatggtcatgctggcggtggacctgaggaagcaaagtaa

SEQ ID NO: 110 - protein, 184 aa, Lactuca serriola
  UNSURE (85)..(85): Xaa can be any naturally ocurring amino acid
MKQPMMPNPMMSSSFPPTNITTDQIQKFLDENKQLIIAIMSNLNLGKLAECAQYQALLQKNLMYLAAIADAQPPTPTPTLNISYXMGPVPHPGMPQQGGFYMAQQHPQAAVMTAQPPSGFPQPMPGMQFNSPQAIQGQMGGRSGGPPSSAASDVWRGSMQDGGGGAAADGGKDGHAGGGPEEAK

SEQ ID NO: 111 - DNA, 627 bp, Lycopersicon esculentum
atgcagcagcacctgatgcagatgcagcccatgatggcagcttactatccaacgaacgtcactactgaccatattcaacagtatttggatgaaaacaaatcactcattctgaagattgttgagagccagaactctgggaaactcagtgaatgtgcggagaaccaagctaggcttcagaggaatctgatgtaccttgctgcgattgctgattcacaacctcaaccttctagcatgcattctcagttctcttctggtgggatgatgcagccagggacacacagttacttgcagcagcagcagcagcaacaacaagcgcaacaaatggcaacacaacaactcatggctgcaagatcctcgtcgatgctctatggacaacagcagcagcaatctcagttatcgcaatatcaacaaggcttgcatagtagccaactcggcatgagttctggcagtggcggaagcactggacttcatcacatgcttcaaagtgaatcatcacctcatggtggtggtttctctcatgacttcggccgcgcaaataagcaagacattgggagtagtatgtctgctgaagggcgcggcggaagttcaggtggtgagaatctttatctgaaagcttctgaggattga

SEQ ID NO: 112 - protein, 208 aa, Lycopersicon esculentum
MQQHLMQMQPMMAAYYPTNVTTDHIQQYLDENKSLILKIVESQNSGKLSECAENQARLQRNLMYLAAIADSQPQPSSMHSQFSSGGMMQPGTHSYLQQQQQQQQAQQMATQQLMAARSSSMLYGQQQQQSQLSQYQQGLHSSQLGMSSGSGGSTGLHHMLQSESSPHGGGFSHDFGRANKQDIGSSMSAEGRGGSSGGENLYLKASED

SEQ ID NO: 113 - DNA, 624 bp, Malus domestica
atgcagcagccaccacaaatgatccccgtcatgccttcatttcctcccaccaacatcaccaccgaacaaattcagaagtaccttgatgacaacaaaaagttgattctggcaatattggataatcaaaatcttggaaaacttgctgagtgtgctcagtaccaggctctgcttcaaaagaatctgatgtatttagcagcaattgccgatgcgcaaccacaggcaccagctgcccctccccagatggccccacatcctgctatgcaacaggcaggatattacatgcaacatcctcaggcagcagcaatggctcagcaacagggtattttctccccaaagatgccgatgcaattcaataacatgcatcaaatgcacgatccacagcagcaccaacaagccatgcaagggcaaatgggaatgagacctggagggcctaacggcatgccttccatgcttcatactgaggccacacatggtggtggtagtggcggcccaaattcagctggagacccaaatgatgggcgtggaggaagcaagcaagacgcctctgagtctggggcaggtggtgatggccaggggacctcagccggcgggcgtggaactggtgatggagaggacggcaagtga

SEQ ID NO: 114 - protein, 207 aa, Malus domestica
MQQPPQMIPVMPSFPPTNITTEQIQKYLDDNKKLILAILDNQNLGKLAECAQYQALLQKNLMYLAAIADAQPQAPAAPPQMAPHPAMQQAGYYMQHPQAAAMAQQQGIFSPKMPMQFNNMHQMHDPQQHQQAMQGQMGMRPGGPNGMPSMLHTEATHGGGSGGPNSAGDPNDGRGGSKQDASESGAGGDGQGTSAGGRGTGDGEDGK

SEQ ID NO: 115 - DNA, 636 bp, Medicago trunculata
atgcagcagcacctgatgcagatgcagcccatgatggcagcttactatcctaacaacgtcactactgatcatattcaacagtatcttgatgagaacaagtccttgattctcaagattgttgaaagccagaacactggcaagctcaccgagtgtgctgagaaccaatcaaggcttcagagaaatctcatgtacctagctgcaatagctgattctcaaccccaaccacctactatgcctggccagtacccttcaagtggaatgatgcagcagggaggacactacatgcaggctcaacaagctcagcagatgacacaacaacaattaatggctgcacgttcctctcttatgtatgctcaacagcttcaacagcagcaagccttgcaaagccaacttggtatgaattccagtggaagtcaaggccttcacatgttgcatagtgaaggggctaatgttggaggcaattcatctctaggggctggttttcctgattttggccgtagctcagccggtgatggtttgcacggcagtggtaagcaagacattggaagcactgatggccgcggtggaagctctagtggtcactctggtgatggcggcgaaacactttacctgaaatcttctggtgatgggaattag

SEQ ID NO: 116 - protein, 211 aa, Medicago trunculata
MQQHLMQMQPMMAAYYPNNVTTDHIQQYLDENKSLILKIVESQNTGKLTECAENQSRLQRNLMYLAAIADSQPQPPTMPGQYPSSGMMQQGGHYMQAQQAQQMTQQQLMAARSSLMYAQQLQQQQALQSQLGMNSSGSQGLHMLHSEGANVGGNSSLGAGFPDFGRSSAGDGLHGSGKQDIGSTDGRGGSSSGHSGDGGETLYLKSSGDGN

SEQ ID NO: 117 - DNA, 639 bp, Medicago trunculata
atgcagcagacacctcaaatgattcctatgatgccttcattcccacaacaaacaaacataaccactgagcagattcaaaaatatcttgatgagaacaagaagctgatcctggcaatattggacaatcaaaatcttggaaaacttgcagaatgtgcccagtaccaagctcagcttcagaagaatttgatgtatttagctgcaattgctgacgcgcagccacaaacaccggccttgcctccacagatggccccgcaccctgcgatgcaacaaggattctatatgcaacatcctcaggctgcagcaatggctcagcaacaaggaatgttcccccaaaaaatgccaatgcagttcggtaatccgcatcaaatgcaggatcagcagcatcagcagcaacaacagcagctacatcagcaagctatgcaaggtcaaatgggacttagacctggagggataaataacggcatgcatccaatgcacaacgaggctgctctcggaggtagcggcagtggtggtcaaatgacgggcgtggtggtggagcaagcaagatgcttcggagctgggacagccggcggtgatggtcaaggaacctctgccgcagctgcgcacaacagtggagatgcttcagaagaaggaaagtaa

SEQ ID NO: 118 - protein, 213 aa, Medicago trunculata
MQQTPQMIPMMPSFPQQTNITTEQIQKYLDENKKLILAILDNQNLGKLAECAQYQAQLQKNLMYLAAIADAQPQTPALPPQMAPHPAMQQGFYMQHPQAAAMAQQQGMFPQKMPMQFGNPHQMQDQQHQQQQQQLHQQAMQGQMGLRPGGINNGMHPMHNEAALGGSGSGGPNDGRGGGSKQDASEAGTAGGDGQGTSAAAAHNSGDASEEGK

SEQ ID NO: 119 - DNA, 684 bp, Oryza sativa
atgcagcagcaacacctgatgcagatgaaccagggcatgatggggggatatgcttcccctaccaccgtcaccactgatctcattcagcagtatctggatgagaacaagcagctgatcctggccatccttgacaaccagaacaatgggaaggtggaagagtgcgctcggaaccaagctaagctccagcacaatctcatgtacctcgccgccatcgccgacagccagccgccgcagacggccgccatgtcccagtatccgtcgaacctgatgatgcagtccggggcgaggtacatgccgcagcagtcggcgcagatgatggcgccgcagtcgctgatggcggcgaggtcttcgatgatgtacgcgcagccggcgctgtcgccgctccagcagcagcagcagcagcaggcggcggcggcgcacgggcagctgggcatgggctcggggggcaccaccagcgggttcagcatcctccacggcgaggccagcatgggcggcggcggcggcggcggtggcgccggtaacagcatgatgaacgccggcgtgttctccgacttcggacgcggcggcggcggcggcggcaaggaggggtccacctcgctgtccgtcgacgtccggggcgccaactccggcgcccagagcggcgacggggagtacctcaagggcaccgaggaggaaggcagctag

SEQ ID NO: 120 - protein, 227 aa, Oryza sativa
MQQQHLMQMNQGMMGGYASPTTVTTDLIQQYLDENKQLILAILDNQNNGKVEECARNQAKLQHNLMYLAAIADSQPPQTAAMSQYPSNLMMQSGARYMPQQSAQMMAPQSLMAARSSMMYAQPALSPLQQQQQQQAAAAHGQLGMGSGGTTSGFSILHGEASMGGGGGGGGAGNSMMNAGVFSDFGRGGGGGGKEGSTSLSVDVRGANSGAQSGDGEYLKGTEEEGS

SEQ ID NO: 121 - DNA, 558 bp, Oryza sativa
atgcagcagcagccgatgccgatgcccgcgcaggcgccgccgacggccggaatcaccaccgagcagatccaaaagtatctggatgaaaacaagcagcttattttggctattttggaaaatcagaatctgggaaagttggcagaatgtgctcagtatcaagcgcagcttcagaagaatctcttgtacttggctgcaattgctgatactcaaccgcagaccactataagccgtccccagatggtgccgcatggtgcatcgccggggttaggggggcaatacatgtcgcaggtgccaatgttcccccccaggacccctctaacgccccagcagatgcaggagcagcagctgcagcaacagcaagcccagctgctctcgttcggcggtcagatggttatgaggcctggcgttgtgaatggcattcctcagcttctgcaaggcgaaatgcaccgcggagcagatcaccagaacgctggcggggccacctcggagccttccgagagccacaggagcaccggcaccgaaaatgacggtggaagcgacttcggcgatcaatcctaa

SEQ ID NO: 122 - protein, 185 aa, Oryza sativa
MQQQPMPMPAQAPPTAGITTEQIQKYLDENKQLILAILENQNLGKLAECAQYQAQLQKNLLYLAAIADTQPQTTISRPQMVPHGASPGLGGQYMSQVPMFPPRTPLTPQQMQEQQLQQQQAQLLSFGGQMVMRPGVVNGIPQLLQGEMHRGADHQNAGGATSEPSESHRSTGTENDGGSDFGDQS

SEQ ID NO: 123 - DNA, 618 bp, Oryza sativa
atgcagcagcagatggccatgccggcgggggccgccgccgccgcggtgccgccggcggccggcatcaccaccgagcagatccaaaagtatttggatgaaaataaacagctaattttggccatcctggaaaatcaaaacctagggaagttggctgaatgtgctcagtaccaagctcagcttcaaaagaatctcttgtatctggctgccattgcagatgcccaaccacctcagaatccaggaagtcgccctcagatgatgcagcctggtgctaccccaggtgctgggcattacatgtcccaagtaccgatgttccctccaagaactcccttaaccccacaacagatgcaagagcagcagcagcagcaactccagcaacagcaagctcaggctctagccttccccggccagatgctaatgagaccaggtactgtcaatggcatgcaatctatcccagttgctgaccctgctcgcgcagccgatcttcagacggcagcaccgggctcggtagatggccgaggaaacaagcaggatgcaacctcggagccttccgggaccgagagccacaagagtgcgggagcagataacgacgcaggcggtgacatagcggagaagtcctga

SEQ ID NO: 124 - protein, 205 aa, Oryza sativa
MQQQMAMPAGAAAAAVPPAAGITTEQIQKYLDENKQLILAILENQNLGKLAECAQYQAQLQKNLLYLAAIADAQPPQNPGSRPQMMQPGATPGAGHYMSQVPMFPPRTPLTPQQMQEQQQQQLQQQQAQALAFPGQMLMRPGTVNGMQSIPVADPARAADLQTAAPGSVDGRGNKQDATSEPSGTESHKSAGADNDAGGDIAEKS

SEQ ID NO: 125 - DNA, 624 bp, Panicum virgatum
atgcagcagcagatgcccatgcagtcggcgcccccggcgaccggcatcaccaccgagcagatccaaaagtatttggatgaaaataagcagcttattttggccatcctggaaaatcagaacttaggaaagttggctgaatgtgctcagtatcaagctcagcttcaaaagaatctcttgtacctggctgcgattgcagatgcccaaccccaaccaccacagaaccctgcaagtcgcccacagatgatgcaacctggcatggtaccaggtgcagggcattacatgtcccaagtaccaatgttcccgccaagaacaccattaaccccgcaacagatgcaagaacagcagcagcagcagcagcagcttcaacagcagcaagcacaggctcttgctttcccgggacagatggtcatgagacctaccattaatggcatgcagcctatgcaagccgaccctgctgccgccgccgccagcctacagcagtcagcacctggccctactgatgggcgaggaggcaagcaagatgcaactgctggggtgagcacagagccttctggcaccgagagccacaagagcacaaccgcagcagatcacgatgtgggcactgatgtcgcggagaaatcctaa

SEQ ID NO: 126 - protein, 207 aa, Panicum virgatum
MQQQMPMQSAPPATGITTEQIQKYLDENKQLILAILENQNLGKLAECAQYQAQLQKNLLYLAAIADAQPQPPQNPASRPQMMQPGMVPGAGHYMSQVPMFPPRTPLTPQQMQEQQQQQQQLQQQQAQALAFPGQMVMRPTINGMQPMQADPAAAAASLQQSAPGPTDGRGGKQDATAGVSTEPSGTESHKSTTAADHDVGTDVAEKS

SEQ ID NO: 127 - DNA, 645 bp, Physcomitrella patens
atgcagcaaatggcggcgtatacggggacgtctattaccacggagctaatccagaagtatctggacgagaacaagcagcttatcctcgcgattcttgacaatcaaaaccttggaaagctgaacgaatgcgctatgtatcaagcaaagttgcagcagaatcttatgtacctcgcagccattgcggatgcacaacctcaagtgagccaaaactcaactcaggtctcatcaggacaatctatgcagccctctcagcaatatattcaacagcagcagcagcagcagatgatgatgatgaatcagcgaaactcaatcccacaatacatgcaacaaagccaacaggggtcaccaaacgcaccatcaccgcagcagcagtcctaccacagccagcagccgcaaggtatggttccccagagaaactcagacatgcacttggtgaaaaactctacaggaggcaacggtaatcagacaggaggtagtgtatccgagtatggaaagcctgaggaatcccgggaggggaccccaacaagcttaagcacaagaaacgatggtccacaggcgggggcttctccgttgggacaagcgagagaaggcaatggagctgctggagaggactctgaggcttcttacttgaaaagctccgactaa

SEQ ID NO: 128 - protein, 214 aa, Physcomitrella patens
MQQMAAYTGTSITTELIQKYLDENKQLILAILDNQNLGKLNECAMYQAKLQQNLMYLAAIADAQPQVSQNSTQVSSGQSMQPSQQYIQQQQQQQMMMMNQRNSIPQYMQQSQQGSPNAPSPQQQSYHSQQPQGMVPQRNSDMHLVKNSTGGNGNQTGGSVSEYGKPEESREGTPTSLSTRNDGPQAGASPLGQAREGNGAAGEDSEASYLKSSD

SEQ ID NO: 129 - DNA, 609 bp, Physcomitrella patens
atgcagcaaatggcgccgtatgcggggacatctatcactactgagctcatccagaagtacctggacgagaacaagcagctgattctcgcaattctcgataatcaaaaccttggaaagctgaacgaatgtgctacgtatcaagcaaagttgcagcagaatcttatgtacctcgcagctattgcagacgcacaaccccaagttccagcagcacaaccaatgcaaccatcacagcaatatattcagcagcagcagcagcagatgatgatgaatcaacgaaatcagtacttgcagcaaaatcaacaaggagtacaaaacgcaccatcaccgcagtcgcagcagtcgtatcacaaccagcagccaggcatggtctcccagggaaactcggggatgcacatggtgaatagttccatgggtggtaatggcaaccagacaggaggaaatgtttccgagtatgggaaaccagaagattcccgggaggggactccaacaagcttgaatacaaggaatgaaggtccacaagcgggggcttccccactgggacaagcaagagaagggaatggtgcgccaggagaggattcagaggcttcatacttaaaaagctccgagtga

SEQ ID NO: 130 - protein, 202 aa, Physcomitrella patens
MQQMAPYAGTSITTELIQKYLDENKQLILAILDNQNLGKLNECATYQAKLQQNLMYLAAIADAQPQVPAAQPMQPSQQYIQQQQQQMMMNQRNQYLQQNQQGVQNAPSPQSQQSYHNQQPGMVSQGNSGMHMVNSSMGGNGNQTGGNVSEYGKPEDSREGTPTSLNTRNEGPQAGASPLGQAREGNGAPGEDSEASYLKSSE

SEQ ID NO: 131 - DNA, 654 bp, Physcomitrella patens
atgatgcagcacatggcgacgtatgccagctccaacatcacaacggagctcattcagaagtacttggacgagaataagcagttgattctcgctatcctcgacaaccaaaacctcggcaagctcaatgagtgtgcaacgtatcaagcgaagttgcagcagaatctcatgtatttggctgccatagctgatgctcagccacaaggcccatcttcgcagatgccagcacctgcgccggcgccaaccatgcaaccagctcagcagtacatgcaacagcagcaacaactccggatgatgagccaacagaacagtatgatcccttcctaccttcagcacagccaacaagcatcgcagcagaacttctacagtcaacaaagcctgctctccgggggagggggctcaatacacatgatgtccacggaccgcggcatcggaggcaatggatcccaggcttcgccaggatattctgatggagggcgggatcagagccaaatgggtttggcaatgcagggcgacatgcatggtggaaacgggacggacctggggtgctcctccccgcttggccaccgaggagacggtggtaacggccacggccaggggaccgatgactctgaagcttcctacttgaagggatctgatgggagcagtctgaattaa

SEQ ID NO: 132 - protein, 217 aa, Physcomitrella patens
MMQHMATYASSNITTELIQKYLDENKQLILAILDNQNLGKLNECATYQAKLQQNLMYLAAIADAQPQGPSSQMPAPAPAPTMQPAQQYMQQQQQLRMMSQQNSMIPSYLQHSQQASQQNFYSQQSLLSGGGGSIHMMSTDRGIGGNGSQASPGYSDGGRDQSQMGLAMQGDMHGGNGTDLGCSSPLGHRGDGGNGHGQGTDDSEASYLKGSDGSSLN

SEQ ID NO: 133 - DNA, 648 bp, Physcomitrella patens
atgatgcagcacatgacgacctatgccagctccaacatcaccacggagctcattcagaagtacttggacgagaataaacagctgattctcgccattctcgacaaccaaaacctcggcaagctcaatgagtgtgcgacgtatcaagcgaagctgcagcagaacctcatgtatctggccgctatagctgatgcccagccacaaggcccatctacgcagatgccagcgcccgcgccaactatgcaaccagctcaacaatacatgcaacagcagcaacagctccgcatgatgagccaacaaaatgccatgatcccctcctacctgcagcaaagccaacaagtttcccagcagaacttctacagccaacagagcctgcttaccggcggtggcagctccatccacatgatgtccactgatcgcggcatgggaggcaatgggtcacaagcctcacctggatattctgacggagggcgagatcagaaccaattgggtatgacgatgcagggcgacatgcatggtggaaacggcactgacttgggctgctcctcacctctcggccaccggggagatggcggtggcggccacggccagggcaacgacgactctgaagcttcttacttgaagggttccgatggcagcagtctgaactag

SEQ ID NO: 134 - protein, 215 aa, Physcomitrella patens
MMQHMTTYASSNITTELIQKYLDENKQLILAILDNQNLGKLNECATYQAKLQQNLMYLAAIADAQPQGPSTQMPAPAPTMQPAQQYMQQQQQLRMMSQQNAMIPSYLQQSQQVSQQNFYSQQSLLTGGGSSIHMMSTDRGMGGNGSQASPGYSDGGRDQNQLGMTMQGDMHGGNGTDLGCSSPLGHRGDGGGGHGQGNDDSEASYLKGSDGSSLN

SEQ ID NO: 135 - DNA, 747 bp, Picea sitchensis
atgcagcagcatctcatgcaaatgcagcccatgatggcggcatacgcctccaacaacatcaccactgatcacatccagaagtacctggatgagaacaagcagttgattctggcaattctggacaaccaaaatcttggaaagctcaatgagtgtgctcagtaccaagcaaaacttcagcagaatttgatgtatctggctgcgattgctgattctcaaccacaagcacaaactgcacatgctcagattcctcctaatgcagtgatgcagtctggtgggcattacatgcagcaccagcaggcacagcaacaagtgactcctcagtctctgatggcagctagatcttccatgctgtattctcagcagccgatggctgctttgcatcaagctcagcaacaacagcagcagcagcatcagcagcaacaacaatctcttcacagccagcttggcataaattctggaggaagcagtggattgcatatgttgcatggtgagacaaacatgggatgtaatgggcctctctcatctgggggcttccctgaatttgggcgtgggtctgctacctctgctgaaggtatgcaggccaacaggggcttcactatagatcgtggttcaaataagcaggatggagtaggatcagagaatgcccatccaggtgctggtgatggaagagggagttcaactggagggcagaatgcagatgagtcagaaccatcatacctgaaagcctccgaagaagaaggaaactag

SEQ ID NO: 136 - protein, 248 aa, Picea sitchensis
MQQHLMQMQPMMAAYASNNITTDHIQKYLDENKQLILAILDNQNLGKLNECAQYQAKLQQNLMYLAAIADSQPQAQTAHAQIPPNAVMQSGGHYMQHQQAQQQVTPQSLMAARSSMLYSQQPMAALHQAQQQQQQQHQQQQQSLHSQLGINSGGSSGLHMLHGETNMGCNGPLSSGGFPEFGRGSATSAEGMQANRGFTIDRGSNKQDGVGSENAHPGAGDGRGSSTGGQNADESEPSYLKASEEEGN

SEQ ID NO: 137 - DNA, 735 bp, Pinus taeda
atgcagcagcacctcatgcaaatgcagcccatgatggcggcctacgcctccaacaatatcaccactgatcacatccagaagtacctggatgagaacaagcagttgattctggcaattttggacaaccaaaatctcggaaagctcaatgagtgtgctcaataccaagcaaaacttcagcagaatttgatgtatctggctgctattgctgattctcaacctcaagcacaaactgcacatgctcagattcctccaaatgcggtgatgcagtctggtgggcattacatgcagcatcaacaggcacagcaacaagttactcctcagtctctgatggcagctagatcttccatactgtatgctcagcaacaacagcagcagcagcatcagcagcatcagcagcaacagcagcaacaacagtctcttcacagccagcttggcataaattctggaggaagcagcggtttgcatatgttgcatggtgagacaaacatgggatgtaatgggcctctgtcatctgggggattccctgaatttgggcgtgggtctgctacctctgctgatggtatgcaggtgaacaggggctttgctatagatcgtggttcaaacaagcaggatggagttggatcagagaatgcccatgctggtgctggtgatggaagagggagttcaactggagggcagaatgcagatgagtcagaaccatcatacctgaaggcctccgaggaagaaggaaactag

SEQ ID NO: 138 - protein, 244 aa, Pinus taeda
MQQHLMQMQPMMAAYASNNITTDHIQKYLDENKQLILAILDNQNLGKLNECAQYQAKLQQNLMYLAAIADSQPQAQTAHAQIPPNAVMQSGGHYMQHQQAQQQVTPQSLMAARSSILYAQQQQQQQHQQHQQQQQQQQSLHSQLGINSGGSSGLHMLHGETNMGCNGPLSSGGFPEFGRGSATSADGMQVNRGFAIDRGSNKQDGVGSENAHAGAGDGRGSSTGGQNADESEPSYLKASEEEGN

SEQ ID NO: 139 - DNA, 663 bp, Populus trichocarpa
atgcaacagcacctgatgcagatgcagcccatgatggcagcctattaccccagcaacgtcactactgatcatattcaacagtatctggacgaaaacaagtcattgattttgaagattgttgagagccagaattcagggaaactcagtgagtgtgcagagaaccaagcaagactgcaacaaaatctcatgtacttggctgcaattgctgattgtcagccccaaccacctaccatgcatgcccagttcccttccagcggcattatgcagccaggagcacattacatgcagcatcaacaagctcaacagatgacaccacaagcccttatggctgcacgctcttctatgctgcagtatgctcaacagccattctcagcgcttcaacaacagcaagccttacacagccagctcggcatgagctctggtggaagcgcaggacttcatatgatgcaaagcgaggctaacactgcaggaggcagtggagctcttggtgctggacgatttcctgattttggcatggatgcctccagtagaggaatcgcaagtgggagcaagcaagatattcggagtgcagggtctagtgaagggcgaggaggaagctctggaggccagggtggtgatggaggtgaaaccctttacttgaaatctgctgatgatgggaactga

SEQ ID NO: 140 - protein, 220 aa, Populus trichocarpa
MQQHLMQMQPMMAAYYPSNVTTDHIQQYLDENKSLILKIVESQNSGKLSECAENQARLQQNLMYLAAIADCQPQPPTMHAQFPSSGIMQPGAHYMQHQQAQQMTPQALMAARSSMLQYAQQPFSALQQQQALHSQLGMSSGGSAGLHMMQSEANTAGGSGALGAGRFPDFGMDASSRGIASGSKQDIRSAGSSEGRGGSSGGQGGDGGETLYLKSADDGN

SEQ ID NO: 141 - DNA, 627 bp, Populus trichocarpa
atgcagcagccaccgcaaatgattcctgtcatttctccatttccaccaacaaacatcaccactgagcagatccaaaagtaccttgacgaaaacaaaaagttgattttggctatattggacaaccaaaaccttggaaaacttgctgaatgtgcccagtatcaagcccagctgcagaagaatttgatgtatttggctgcaattgctgatgcccaaccacaggcaccagcaatgcctccccagatggccccgcatcctgcaatgcaacaaggggcatattacatgcaacatcctcaggcagcagcaatggctcagcagccaggtgttttcccccaaaagatgctattacaattcaatgctggacatcaaatgcaggatcctcagcagttacaccaacaagccatgcaagggcaaataggaattagacctataggggctaacaatggcatgcatcccatgcacgctgagattgctcttggaagcagtggcccttcagcaagtgctggcacaaatgatgtacgtgggggaagcaaacaggatgcctctgaggctggcacaaccggtgctgatggcctagggggctctgctgctgggcataatggtgctgacggttccgaggatgcaaaatga

SEQ ID NO: 142 - protein, 208 aa, Populus trichocarpa
MQQPPQMIPVISPFPPTNITTEQIQKYLDENKKLILAILDNQNLGKLAECAQYQAQLQKNLMYLAAIADAQPQAPAMPPQMAPHPAMQQGAYYMQHPQAAAMAQQPGVFPQKMLLQFNAGHQMQDPQQLHQQAMQGQIGIRPIGANNGMHPMHAEIALGSSGPSASAGTNDVRGGSKQDASEAGTTGADGLGGSAAGHNGADGSEDAK

SEQ ID NO: 143 - DNA, 438 bp, Populus trichocarpa
atgcagcagtcaccgcaacaaatgttgagcatcaccactgagcagattcaaaagtacttagaagagaacaagcagctgattatggctatactggagaatcagaacaagggaaacgtttctgaatgtgcttcgtatcaagcccagttacagcagaacctgatgtacctagcaagaattgctgatgcccaaccacaaggaaccacaatgccttctcagatgccccctcagcagcccgcagtgaagcaagagcagtacatgcagccatctcaagttgctatgactcagcaaccaattttcttcaatcagaagctccctttccaaacgaactttcagcatgagcagcagcaacagctgccaccacacctccaacagcaacacttcacccaaggacagatgagaatgagacccggtgtcactgatcaagattctgatgcctaa

SEQ ID NO: 144 - protein, 145 aa, Populus trichocarpa
MQQSPQQMLSITTEQIQKYLEENKQLIMAILENQNKGNVSECASYQAQLQQNLMYLARIADAQPQGTTMPSQMPPQQPAVKQEQYMQPSQVAMTQQPIFFNQKLPFQTNFQHEQQQQLPPHLQQQHFTQGQMRMRPGVTDQDSDA

SEQ ID NO: 145 - DNA, 645 bp, Prunus persica
atgcagcagccacagcaaatgatccctgtgatgcctacttcatttccacccactaacatcaccaccgagcaaattcagaagtaccttgacgagaacaaaaaattgattctggcaatattggataatcaaaaccttggaaaacttgctgagtgtgcccagtaccaagctcagcttcaaaagaatctgatgtatttagcagctattgctgatgcacaaccacaggcaccaacagtgcctgctcagatggccccacatcctgctatgcaacaagcaggatattacatgcaacatcctcaggcagcagcaatggctcagcaacagggtattttccccccaaagatgccattgcagttcaataacccgcaccaaatgcatgatgcagcacagcagctacaccagcagcaccaacaagccatgcaagggcaaatgggaatgagagctggaggggccaatggcatgccttccatgcatcatactgaagccacacttggtggtggtagtggtggccccacttcaggtggagggggtccaaacgatgggcgtggaggaaagcagcaagactactcagaggctgggacaggtggtgatggccaggggagctcagccggcgggcatggcaatggtgatggagaagatggaaagtga

SEQ ID NO: 146 - protein, 214 aa, Prunus persica
MQQPQQMIPVMPTSFPPTNITTEQIQKYLDENKKLILAILDNQNLGKLAECAQYQAQLQKNLMYLAAIADAQPQAPTVPAQMAPHPAMQQAGYYMQHPQAAAMAQQQGIFPPKMPLQFNNPHQMHDAAQQLHQQHQQAMQGQMGMRAGGANGMPSMHHTEATLGGGSGGPTSGGGGPNDGRGGKQQDYSEAGTGGDGQGSSAGGHGNGDGEDGK

SEQ ID NO: 147 - DNA, 678 bp, Saccharum officinarum
atgcagcagcaacacctgatgcagatgaaccagaacatgattgggggctacacctctcctgccgctgtgacaaccgatctcatccagcagtacctggatgagaacaagcagctgatcctggccatcctcgacaaccagaacaatggcaaggtggaggagtgcgaacggcaccaagctaagctccagcacaacctcatgtacctggccgccatcgccgacagccagccaccacagactgcaccactatcacaatacccgtccaacctgatgatgcagccgggccctcggtacatgccaccgcagtccgggcagatgatgagcccgcagtcgctaatggcggcgcggtcctccatgatgtacgcgcacccgtccatgtcaccactccagcagcagcaggcagcgcacgggcagctgggcatggcttcagggggcggcggtggcacgaccagtgggttcaacatcctccatggcgaggccagtatgggcggtgctggtggcgcttgtgccggcaacaacatgatgaacgccggcatgttctcaggctttggccgcagcggcagtggcgccaaggagggatcgacctcgctgtcggttgacgtccgtggtggcaccagctccggcgcgcaaagcggggacggcgagtacctgaaagcaggcaccgaggaagaaggcagttaa

SEQ ID NO: 148 - protein, 225 aa, Saccharum officinarum
MQQQHLMQMNQNMIGGYTSPAAVTTDLIQQYLDENKQLILAILDNQNNGKVEECERHQAKLQHNLMYLAAIADSQPPQTAPLSQYPSNLMMQPGPRYMPPQSGQMMSPQSLMAARSSMMYAHPSMSPLQQQQAAHGQLGMASGGGGGTTSGFNILHGEASMGGAGGACAGNNMMNAGMFSGFGRSGSGAKEGSTSLSVDVRGGTSSGAQSGDGEYLKAGTEEEGS

SEQ ID NO: 149 - DNA, 561 bp, Saccharum officinarum
atgcagcagccgatgcccatgcagccgcaggcgccggagatgaccccggccgccggaatcaccacggagcagatccaaaagtatctggatgagaataagcagcttattttggctattttggaaaatcagaacctaggaaaattggcagaatgtgctcagtatcaatcacaacttcagaagaacctcttgtatctcgctgcaatcgcagatgcccaaccacagactgctgtaagccgccctcagatggcgccgcctggtgcattgcctggagtagggcagtacatgtcacaggtgcctatgttcccaccgaggacacctctaacaccccagcagatgcaggagcagcaacttcagcagcagcaggctcagctgctaaatttcagtggcctaatggttgctagacctggcatggtcaacggcatgcctcagtccattcaagttcagcaagctcagccaccaccagcagggaacaaacaggatgctggtggggtcgcctcggagccctcgggcattgagaaccacaggagcactggtggtgataatgatggtggaagcgactag

SEQ ID NO: 150 - protein, 186 aa, Saccharum officinarum
MQQPMPMQPQAPEMTPAAGITTEQIQKYLDENKQLILAILENQNLGKLAECAQYQSQLQKNLLYLAAIADAQPQTAVSRPQMAPPGALPGVGQYMSQVPMFPPRTPLTPQQMQEQQLQQQQAQLLNFSGLMVARPGMVNGMPQSIQVQQAQPPPAGNKQDAGGVASEPSGIENHRSTGGDNDGGSD

SEQ ID NO: 151 - DNA, 642 bp, Saccharum officinarum
atgcagcagcagatgcccatgccgccggcgcccgctgcggcggcggcgcccccggcggccggcatcaccaccgagcagatccaaaagtatttggacgaaaataagcaacttattttggccatcctggaaaatcagaacttaggaaagttggctgaatgtgctcagtatcaagctcaacttcaaaagaacctcttgtacctggctgcgattgctgatgcccaaccccagccaccacaaaaccctgcaggtcgccctcagatgatgcaacctggtatagtgccaggtgcggggcattacatgtcacaagtaccaatgttccctccaagaactccattaaccccacagcagatgcaagagcagcagcagcaacagcttcagcagcagcaagcgcaggctcttacattccctggacagatggtcatgagaccagctaccatcaacggcatacagcagcctatgcaagctgaccctgcccgggcagcggagctgcaacaaccaccacctatcccagctgacgggcgagtaagcaagcagcaggacacaacggctggcgtgagctcagagccttctgccaatgagagccacaagaccacaactggagcagatagtgaggcaggtggtgacgtggcggagaaatcctaa

SEQ ID NO: 152 - protein, 213 aa, Saccharum officinarum
MQQQMPMPPAPAAAAAPPAAGITTEQIQKYLDENKQLILAILENQNLGKLAECAQYQAQLQKNLLYLAAIADAQPQPPQNPAGRPQMMQPGIVPGAGHYMSQVPMFPPRTPLTPQQMQEQQQQQLQQQQAQALTFPGQMVMRPATINGIQQPMQADPARAAELQQPPPIPADGRVSKQQDTTAGVSSEPSANESHKTTTGADSEAGGDVAEKS

SEQ ID NO: 153 - DNA, 645 bp, Solanum tuberosum
atgcagcagcacctgatgcagatgcagcccatgatggcagcttactatccaacgaacgtcactactgaccatattcaacagtatttggatgagaacaaatcactcattctgaaaattgttgagagccaaaactcgggaaaactcagtgaatgtgcagagaaccaagctaggcttcagaggaatctgatgtaccttgctgctattgctgattcacaacctcagccttctagcatgcattctcagttctcttctggtgggatgatgcagccagggacacacagttacctgcagcagcagcagcagcaacaacaagcgcaacaaatggcaacacaacaactcatggctgcaagatcctcatcaatgctctatggacaacaacagcagcagcagcagcagtctcagttatcacaatttcaacaaggcttgcatagtagccaacttggcatgagttctggcagtggtggaagcactggacttcatcacatgcttcaaagtgaatcatcacctcatggtggtggtttctctcatgacttcggccgtgcaaataagcaagacattgggagtagtatgtctgctgaagggcgcggcggaagctcaggtggtgatggtggtgagaatctttatctgaaagcttctgaggattga

SEQ ID NO: 154 - protein, 214 aa, Solanum tuberosum
MQQHLMQMQPMMAAYYPTNVTTDHIQQYLDENKSLILKIVESQNSGKLSECAENQARLQRNLMYLAAIADSQPQPSSMHSQFSSGGMMQPGTHSYLQQQQQQQQAQQMATQQLMAARSSSMLYGQQQQQQQQSQLSQFQQGLHSSQLGMSSGSGGSTGLHHMLQSESSPHGGGFSHDFGRANKQDIGSSMSAEGRGGSSGGDGGENLYLKASED

SEQ ID NO: 155 - DNA, 681 bp, Solanum tuberosum
atgcagcagcagcacctgatgcagatgcagcccatgatggcagcctattatcccaacaatgtcactactgatcatattcaacagttcctggatgagaacaaatcacttattctgaagattgttgagagccagaactctgggaaaataagtgaatgtgcagagtcccaagctaaacttcagagaaatcttatgtaccttgcagctattgctgattcacagccccagcctcctagtatgcattcacagttagcttctggtgggatgatgcagggaggggcacattatatgcagcaacaacaagctcaacaactcacaacgcaatcgcttatggctgcagcaagatcctcctcctcaatgctctatggacaacaacaacaacaacaacaacaacaactatcatcattgcaacaacagcaagcagcctttcatagccagcaactcggaatgagcagctctggtggaggaagcagtagtggacttcacatgctacaaagcgaaaacactcatagtgctagcactggtggtggtggtttccctgactttggcagaggattaggcagtggaaacaagcatgaaatgggaagttctatgtctgatcaaggacggggcggaagctcgagtggtcatggtggtgatggaggtgagaatctttacttgaaatcttctgaagatgggaattag

SEQ ID NO: 156 - protein, 226 aa, Solanum tuberosum
MQQQHLMQMQPMMAAYYPNNVTTDHIQQFLDENKSLILKIVESQNSGKISECAESQAKLQRNLMYLAAIADSQPQPPSMHSQLASGGMMQGGAHYMQQQQAQQLTTQSLMAAARSSSSMLYGQQQQQQQQQLSSLQQQQAAFHSQQLGMSSSGGGSSSGLHMLQSENTHSASTGGGGFPDFGRGLGSGNKHEMGSSMSDQGRGGSSSGHGGDGGENLYLKSSEDGN

SEQ ID NO: 157 - DNA, 615 bp, Solanum tuberosum
atgcagcaaccaccacccatgattccaatgatgccctcttttccttctcctaatatcactactgagcagattcaaaagtacctggacgagaacaagacattgattttggccatattggaccatcaaaatcttgggaaactagctgaatgtgcacagtaccaggctaaacttcagaagaacttgatgtacttggccgctattgctgatgctcaaccacaatcaccagctattccaacgcaaatggctcctcatcctgcaatgcaacaaggaggattttacatgcagcaccctcaggctgcagccatgactcaacaacaaggtatgtttacttcaaagatgccactgcagttcaacaacccacagcaactacacgatcagcagcagcttcaacatcaacatcaacatcaacaactacagcgacagcagcaaggtatgcaacttggaggtgccaacagtggaatgcactccactcttggtagtacaagtaatgttagccagcttacaacttcaggtgctggtgatgcacgcggaggaaacaaacaagacaactctgaagcgggtgctgatggtcaggctagctcagtgactgcccaagtctcggaagaacgcaagtga

SEQ ID NO: 158 - protein, 204 aa, Solanum tuberosum
MQQPPPMIPMMPSFPSPNITTEQIQKYLDENKTLILAILDHQNLGKLAECAQYQAKLQKNLMYLAAIADAQPQSPAIPTQMAPHPAMQQGGFYMQHPQAAAMTQQQGMFTSKMPLQFNNPQQLHDQQQLQHQHQHQQLQRQQQGMQLGGANSGMHSTLGSTSNVSQLTTSGAGDARGGNKQDNSEAGADGQASSVTAQVSEERK

SEQ ID NO: 159 - DNA, 678 bp, Sorghum bicolor
atgcagcagcaacacctgatgcagatgaaccagaacatgattgggggctacacctctcctgccgctgtgaccaccgatctcatccagcagtacctggatgagaacaagcagctgatcctggccatcctcgacaaccagaacaatggaaaggtggaggagtgcgaacggcaccaagctaagctccagcacaacctcatgtacctggcggccatcgctgacagccagccaccacagactgcaccactatcacagtacccgtccaacctgatgatgcagccaggccctcggtacatgccaccgcagtccgggcagatgatgagcccgcagtcgctaatggcggcgcggtcctccatgatgtacgcgcacccgtccatgtcgccactccagcagcagcaggcagcgcacggccagctgggcatggcttcagggggcggcggtggcacgaccagtgggttcagcatcctccacggcgaggccagcatgggcggtgctgctggcgcaggcaccggcaacagcatgatgaacgccggcatgttctcaggctttggccgcagcggcagtggcgccaaggagggatcgacctcgctgtctgttgacgtccgtggtggcaccagctccggcgcgcagagcggggacggcgagtacctgaaagcaggcaccgaggaagaaggcagttaa

SEQ ID NO: 160 - protein, 225 aa, Sorghum bicolor
MQQQHLMQMNQNMIGGYTSPAAVTTDLIQQYLDENKQLILAILDNQNNGKVEECERHQAKLQHNLMYLAAIADSQPPQTAPLSQYPSNLMMQPGPRYMPPQSGQMMSPQSLMAARSSMMYAHPSMSPLQQQQAAHGQLGMASGGGGGTTSGFSILHGEASMGGAAGAGTGNSMMNAGMFSGFGRSGSGAKEGSTSLSVDVRGGTSSGAQSGDGEYLKAGTEEEGS

SEQ ID NO: 161 - DNA, 561 bp, Sorghum bicolor
atgcagcagccgatgcccatgcagccgcaggcgccggcgatgaccccggccgccggaatcaccacggagcagatccaaaagtatctggatgagaataagcagcttattttggctattttggaaaatcagaacctaggaaaattggcagaatgtgctcagtatcaatcacaacttcagaagaacctcttgtatctcgctgcaatcgcagatgcccaaccacagactgctgtaagccgccctcagatggcgccgcctggtgcattgcctggagtagggcagtacatgtcacaggtgcctatgttcccaccaaggacacctctcacaccccaacagatgcaggagcagcaacttcagcagcagcaggctcagttgctaaatttcagtggccagatggttgctagacctggcatggtcaacggcatgcctcagtccattcaagctcaacaagctcagccatcaccagcattgaacaaacaggatgctggtggagtcgcctcagagccctcgggcactgagagccacaggagcactggtggtgataatgatggtggaagcgactag

SEQ ID NO: 162 - protein, 186 aa, Sorghum bicolor
MQQPMPMQPQAPAMTPAAGITTEQIQKYLDENKQLILAILENQNLGKLAECAQYQSQLQKNLLYLAAIADAQPQTAVSRPQMAPPGALPGVGQYMSQVPMFPPRTPLTPQQMQEQQLQQQQAQLLNFSGQMVARPGMVNGMPQSIQAQQAQPSPALNKQDAGGVASEPSGTESHRSTGGDNDGGSD

SEQ ID NO: 163 - DNA, 645 bp, Sorghum bicolor
atgcagcagcagatgcccatgccgccggcgcccgctgcggcggcggcgacggcgcccccggcggccggcatcaccaccgagcagatccagaagtatttggacgaaaataagcaacttattttggccatcctagaaaatcagaacttaggaaagttggctgaatgtgctcagtatcaagctcaacttcaaaagaacctcttgtacctggctgcgattgctgatgcccaaccccgaccaccgcaaaaccctgcaggtcgccctcagatgatgcaacctggtatagtgccaggtgcagggcattacatgtcacaagtaccaatgttccctccaagaactccattaaccccacagcaaatgcaagagcagcagcagcaacagcttcagcagcagcaagcgcaggctcttgcattccctgggcagatggtcatgagaccagctaccatcaacggcatgcagcagcctatgcaggctgaccctgcccgggcagcggagctgcaacagccagcatctgtcccagccgacgggcgagtaagcaagcaggacacagcggctggggtgagctcagagccttctgccaatgagagccacaagaccacaaccggagcagatagtgaggcaggtggagacgtggcggagaaatcctaa

SEQ ID NO: 164 - protein, 214 aa, Sorghum bicolor
MQQQMPMPPAPAAAAATAPPAAGITTEQIQKYLDENKQLILAILENQNLGKLAECAQYQAQLQKNLLYLAAIADAQPRPPQNPAGRPQMMQPGIVPGAGHYMSQVPMFPPRTPLTPQQMQEQQQQQLQQQQAQALAFPGQMVMRPATINGMQQPMQADPARAAELQQPASVPADGRVSKQDTAAGVSSEPSANESHKTTTGADSEAGGDVAEKS

SEQ ID NO: 165 - DNA, 552 bp, Taraxacum officinale
atgaagcagccgatgatgcctaatccaatgatgtcttctccgtttcctccttccaacatcaccaccgatcagatccaaaagttcctagacgaaaacaagcaactgatattagcaataatgaacaaccaaaacctaggaaagcttgctgaatgtgcccagtatcaagctctactccaaaagaatttaatgtatctagcagccattgcagatgctcaaccaccaacaccaacaccaacaccaaatatctcatctcagatgggcccggttccacatccagggatgccacaacaaggtggattctacatggggcagcaccctcaagcggcagtaatggcggctcagccaccttctggtttcccacaaccaatgccaggcatgcagtttaataccccacagggtatccaaggtcagatgggcgggaggtccggtgggccaccaaactcagctggcggcgatgtttggagaggaagcatgcaagatggtggtggtggcggtgttgatggtggtaaggatggtcatgctggcggtggtccaccggaggaaggaaagtga

SEQ ID NO: 166 - protein, 183 aa, Taraxacum officinale
MKQPMMPNPMMSSPFPPSNITTDQIQKFLDENKQLILAIMNNQNLGKLAECAQYQALLQKNLMYLAAIADAQPPTPTPTPNISSQMGPVPHPGMPQQGGFYMGQHPQAAVMAAQPPSGFPQPMPGMQFNTPQGIQGQMGGRSGGPPNSAGGDVWRGSMQDGGGGGVDGGKDGHAGGGPPEEGK

SEQ ID NO: 167 - DNA, 636 bp, Taraxacum officinale
atgcagcagcaacagcatcaacaaccaccgcaatcgcaactgcaaccgcccaccttaaactccggtgctccattttctcccaatgcgatcacctccgaccagattcaaaagtgtctggatgacaacgagaacctgattatagcaatattggaaaatcaaaatcttgggaaatttcaggagtgtgctcagtatcaagccattctccaaaagaacttaatgtatttagctgcaattgctgatgctcaaccaccaacacaacaaccatcaactcctcaaatgccaccaaattccattcctcaacaaccaaacaattacatgcaacaacaacaccaaatcaccgcccctcaacaaggcggcataggtggtggtggcggtgttccaaaactaccctttcaacttaatgcccttcgtacacaagatcaacaacaacaattactccaatttcaacaacaacaacaacttcaagcacaaatggggatgagacctagttcccaagatgggatgcttggaatgcatcaagctatgcagtctgcactcgcgggcaatccgggcagtttgatggatggtagagggaacaagcaagatggatcagaggcggcggcttctggtggtggtggtggtaatagagaatcatga

SEQ ID NO: 168 - protein, 211 aa, Taraxacum officinale
MQQQQHQQPPQSQLQPPTLNSGAPFSPNAITSDQIQKCLDDNENLIIAILENQNLGKFQECAQYQAILQKNLMYLAAIADAQPPTQQPSTPQMPPNSIPQQPNNYMQQQHQITAPQQGGIGGGGGVPKLPFQLNALRTQDQQQQLLQFQQQQQLQAQMGMRPSSQDGMLGMHQAMQSALAGNPGSLMDGRGNKQDGSEAAASGGGGGNRES

SEQ ID NO: 169 - DNA, 678 bp, Triticum aestivum
atgcagcagcaacacctgatgcagatgaaccagagcatgatggggggctacgcttcctctaccactgtcaccactgatctcattcagcagtacctggatgagaacaagcagctgatcctggccatcctcgacaaccagaacaacggcaaggtggaggagtgcgcacggaaccaagctaagctccagcagaacctcatgtacctcgccgccatcgccgacagccagcctccgcagacggcatcgctgtctcagtacccgtccaacctgatgatgcagtccgggccgcggtacatgcagcagcagtcggcgcagatgatgtcgccgcagtcgctgatggcggcgcggtcgtcgatgatgtacgcgcagcaggccatgtcgccgctccagcagcagcagcagcagcagcaccaggcggccgcgcacggccagctggggatgtcctccggcgcgaccaccgggttcaacctcctccacggcgaggccagcatgggcggcggcggcggcggcgccagtggcaacagcatgatgaacgccggcgtcttctcggactaccgccgcggcggcagcggcgccaaggaggggtcgacctcgctgtcggccgacgctcgcggcgccaactctggcgcgcacagcggcgacggggagtacctcaagggcaccgaggaggaaggaagctag

SEQ ID NO: 170 - protein, 225 aa, Triticum aestivum
MQQQHLMQMNQSMMGGYASSTTVTTDLIQQYLDENKQLILAILDNQNNGKVEECARNQAKLQQNLMYLAAIADSQPPQTASLSQYPSNLMMQSGPRYMQQQSAQMMSPQSLMAARSSMMYAQQAMSPLQQQQQQQHQAAAHGQLGMSSGATTGFNLLHGEASMGGGGGGASGNSMMNAGVFSDYRRGGSGAKEGSTSLSADARGANSGAHSGDGEYLKGTEEEGS

SEQ ID NO: 171 - DNA, 558 bp, Triticum aestivum
atgcagcaagcgatgcccatgccgccggcggcggcggcgccggggatgcctccgtctgctggcctcagcaccgagcagatccaaaagtacctggatgaaaataagcaactaattttggctatcttggaaaatcagaacctgggaaagttggcggaatgtgctcagtatcaagctcagcttcagaagaatcttttgtatttggctgcaatcgctgatactcagccacagaccactgtaagccgtcctcagatggcaccacctagtgcatccccaggggcagggcattacatgtcacaggtgccaatgttccctccgaggacccctctaacgcctcagcagatgcaggagcagcaactacagcagcaacaggctcagatgcttccgtttgctggtcaaatggttgcgagacctggggctgtcaatggcatgcctcaggcccctcaagttgaaccagcctatgcagcaggtggggccagttctgagccttctggcactgagagccacaggagcactggtgccgataatgacggggggagcggctgggctgatcagtcctaa

SEQ ID NO: 172 - protein, 185 aa, Triticum aestivum
MQQAMPMPPAAAAPGMPPSAGLSTEQIQKYLDENKQLILAILENQNLGKLAECAQYQAQLQKNLLYLAAIADTQPQTTVSRPQMAPPSASPGAGHYMSQVPMFPPRTPLTPQQMQEQQLQQQQAQMLPFAGQMVARPGAVNGMPQAPQVEPAYAAGGASSEPSGTESHRSTGADNDGGSGWADQS

SEQ ID NO: 173 - DNA, 603 bp, Triticum aestivum
atgcagcaggcgatgtccttgcccccgggagcggtcggcgcggtgtcctcgccggccggcatcaccaccgagcagatccaaaagtatttggatgaaaataagcaacttattttggccatccttgaaaatcagaacctaggaaagttggctgaatgtgctcagtatcaagctcaactccaaaagaatctcttgtatctagctgctatcgcggatgcccaaccaccacagaaccctacaagtcaccctcagatggtgcagcctggtagtatgcaaggtgcagggcattacatgtcacaagtaccaatgttccctccaagaacgcctttaaccccacagcagatgcaagagcagcagcaccagcagcttcagcagcagcaagcccaggccctttctttccccgcccaggtggtcatgagaccaggcaccgtcaacggcatgcagcagcctatgcaagcagccggcgacctccagccagcagcagcacctggagggagcaagcaggacgccgcagtggctggggccagctcggaaccatctggcaccaagagccacaagaacgcgggagcagaggaggtgggcgctgatgtagcagaacaatcctaa

SEQ ID NO: 174 - protein, 200 aa, Triticum aestivum
MQQAMSLPPGAVGAVSSPAGITTEQIQKYLDENKQLILAILENQNLGKLAECAQYQAQLQKNLLYLAAIADAQPPQNPTSHPQMVQPGSMQGAGHYMSQVPMFPPRTPLTPQQMQEQQHQQLQQQQAQALSFPAQVVMRPGTVNGMQQPMQAAGDLQPAAAPGGSKQDAAVAGASSEPSGTKSHKNAGAEEVGADVAEQS

SEQ ID NO: 175 - DNA, 672 bp, Vitis vinifera
atgcagcagcacctgatgcagatgcagcccatgatggcagcctattaccccagcaacgtcaccactgatcacattcagcagtatcttgatgaaaacaagtcattgattctgaagattgttgagagccagaattcaggaaaattgactgaatgtgcagagaaccaggcaagactacagagaaacctcatgtacctggctgcaattgctgattctcaaccccaaccacccaccatgcatgctcagttccctcctagtggcattgttcagccaggagctcactacatgcaacaccaacaagctcaacaaatgacaccacagtcgctcctggctgcacgctcctccatgctgtacacccaacaaccattttcggccctgcaacaacaacaagccatccatagccagcttggcatgggctctggtggaagtgcaggacttcacatgctgcaaagcgaggggagtaatccaggaggcaatggaacactggggactggtgggtttcctgatttcagccgtggaacttctggagaaggcctgcaggctgcaggcaggggaatggctggtgggagcaagcaagatatgggaaatgcagaagggcgaggagggaactcaggaggtcagggtggggatggaggtgagactctttacttgaaagctgctgaagatgggaattga

SEQ ID NO: 176 - protein, 223 aa, Vitis vinifera
MQQHLMQMQPMMAAYYPSNVTTDHIQQYLDENKSLILKIVESQNSGKLTECAENQARLQRNLMYLAAIADSQPQPPTMHAQFPPSGIVQPGAHYMQHQQAQQMTPQSLLAARSSMLYTQQPFSALQQQQAIHSQLGMGSGGSAGLHMLQSEGSNPGGNGTLGTGGFPDFSRGTSGEGLQAAGRGMAGGSKQDMGNAEGRGGNSGGQGGDGGETLYLKAAEDGN

SEQ ID NO: 177 - DNA, 675 bp, Vitis vinifera
atgcagcaacaccttatgcagatgcagcctatgatggcaggaagccataacctcagcagcatcactactgatcacatccaacagtacctagatgagaacaagtctttgattttgaaaattcttgagagccaaaattcagggaaactcagtgaatgtgcggagaaccaagcaagacttcagcgaaaccttatgtaccttgctgcaattgctgattgccaaccacaaccaccatccctgcaggctcagttttcccccaatatggtcatgcaaccaggagtcaactacatgcagcaccaacaatcccaacagatgatgccacagtcactaatggcagcccgagcacccatgttgtatgctcagcagcatccatatttggcattgcagcaacaacaagctctacaaagccagcttggcatgagctccactggaatgggtggaatccacatgctacaaagtgaacctaatgttggagggaatgggactggagccttttccgatcttggtcgcagcatgactggggagggcttgtcggctgtgagcaggggactgggtagtgcaagcaagcaagatgtggggagtgtaggctctgcggaaggtcgacgtggctacttgggagggcaaggtgcagataaaggagaaactctttactttaaaagtgctgaagaaaaggactga

SEQ ID NO: 178 - protein, 224 aa, Vitis vinifera
MQQHLMQMQPMMAGSHNLSSITTDHIQQYLDENKSLILKILESQNSGKLSECAENQARLQRNLMYLAAIADCQPQPPSLQAQFSPNMVMQPGVNYMQHQQSQQMMPQSLMAARAPMLYAQQHPYLALQQQQALQSQLGMSSTGMGGIHMLQSEPNVGGNGTGAFSDLGRSMTGEGLSAVSRGLGSASKQDVGSVGSAEGRRGYLGGQGADKGETLYFKSAEEKD

SEQ ID NO: 179 - DNA, 669 bp, Vitis vinifera
atgcagcagaacccccagatgatacctgttatgccttcttttccacccaacaacatcactaccgagcagattcagaagtatctcgatgagaataaaaaattgattctggcaatattggacaatcaaaaccttggaaagcttgctgagtgtgcacagtaccaagctcagcttcaaaagaatttgatgtatctagctgcaattgctgatgctcagccacaggcaccaccgacaatgcctccccagatggccccacaccctgcaatgcagcagggagggtactacatgcagcatccccaggcggcagcaatggctcagcaacctggtcttttccctcccaagatgcccttacaatttggtaacccacatcaacttcaggagcaagcacagcagctgcagcagctacagcaacaagccatgcaagggcagatgggcatgagacctggaggggccaacaacggcatgcatcccatgcatcctgaggccactcttggtggtggcagcagtggtggccctccaccatctgccggcctcagtgatgcacgcggaggtggcaagcaagacacttccgaagcaggggcttctggtggtgatggtcaggggagctcagctgctgggcatggcggcgatggcgaatcaccctacttgaaggggtcagaggatggaaagtga

SEQ ID NO: 180 - protein, 222 aa, Vitis vinifera
MQQNPQMIPVMPSFPPNNITTEQIQKYLDENKKLILAILDNQNLGKLAECAQYQAQLQKNLMYLAAIADAQPQAPPTMPPQMAPHPAMQQGGYYMQHPQAAAMAQQPGLFPPKMPLQFGNPHQLQEQAQQLQQLQQQAMQGQMGMRPGGANNGMHPMHPEATLGGGSSGGPPPSAGLSDARGGGKQDTSEAGASGGDGQGSSAAGHGGDGESPYLKGSEDGK

SEQ ID NO: 181 - DNA, 597 bp, Vitis vinifera
atgcagcagcaaccaccacagatgatgaacattgcgccttcatttcctcccaccgccatcaccactgagcagattcagaagtatctggatgagaacaaacaattgattctggcaattctggaaaaccagacccttggaaaactcgccgagtgtgcccaatatcaagcccagcttcagaagaacttgatatatctagctgcaattgctgatgcccaaccaccagcaccaacagtgcctcctcagatgcctatacatcatgccatgcaacaagggcattacatgcaacaccctcaggctgctgcagctcagcaacaaccaggcatgtttggtgcaaagttgcctttccagcttagcgatcagcaacagcagcagcagcatcattttttacacctccaacaacagcaacccatccaagggctcatgggcatgaggcctatcatcaacaatggcatgcatcaggccatgcaaactgggcttggtgctttgagcggtttcatggatgtacgtggaagcaagccagatggctcagaggttggttttggtgatggccaagggaagtttgcttctggacatggcagtggaaatagagattcctaa

SEQ ID NO: 182 - protein, 198 aa, Vitis vinifera
MQQQPPQMMNIAPSFPPTAITTEQIQKYLDENKQLILAILENQTLGKLAECAQYQAQLQKNLIYLAAIADAQPPAPTVPPQMPIHHAMQQGHYMQHPQAAAAQQQPGMFGAKLPFQLSDQQQQQQHHFLHLQQQQPIQGLMGMRPIINNGMHQAMQTGLGALSGFMDVRGSKPDGSEVGFGDGQGKFASGHGSGNRDS

SEQ ID NO: 183 - DNA, 735 bp, Volvox carteri
atggcggcagtgtcaggtcaggccaagccagccccaatgacaacggagcgaatccaagaaatgcttgaagaaaacttcaagtttatcaaggcactcgccgaacagcaaaaccttggtcgaatgcaggacgtcatccagttccagcagaagcttcaagaaaaccttatgctactagcagctgtggcggacacctactcatcagcgtctgcaacgggagctgctgcccaggcgactgcagctcccggcatggcggcacaggcggcccggccgcccgctgctgctctccctggaacagctgttgctacggcggcgctcccgctccctggcttgccgcaacaacagcaaccgcagcagcagcagcagccgcagcagcagccagggcagcccagcccgctaatgatggtcatgccgggctcttccgggacgcaggcgcctacgcaactgggggccatgcaactcacgcagcagcagatacaagctgcggtacagcaagcgctagtccgacagcagcagcagcaacaacaacagcagcagcaaaatccaaatccgtttcaggggcagcaattccagctgccacagtcacttcagcagccgcagtccctgggacagcagccagttttaagtgcgatgggggccctgggagggcccttggctggtcaggggacggcggcagggcaggcgggagcaggtggtttccagctgcccgcggcgcctcctttgaaccttgggctttga

SEQ ID NO: 184 - protein, 244 aa, Volvox carteri
MAAVSGQAKPAPMTTERIQEMLEENFKFIKALAEQQNLGRMQDVIQFQQKLQENLMLLAAVADTYSSASATGAAAQATAAPGMAAQAARPPAAALPGTAVATAALPLPGLPQQQQPQQQQQPQQQPGQPSPLMMVMPGSSGTQAPTQLGAMQLTQQQIQAAVQQALVRQQQQQQQQQQQNPNPFQGQQFQLPQSLQQPQSLGQQPVLSAMGALGGPLAGQGTAAGQAGAGGFQLPAAPPLNLGL

SEQ ID NO: 185 - DNA, 699 bp, Welwitschia mirabilis
atgcaaatgcagcctatgataggggcaggatactcctccaatagcatcaccactgatcacattcagaagtatttggatgagaataggcaattgattctggcaattcttgacaaccaaaatcttggaaagttgaatgaatgtgcacaataccaagccaggcttcaacaaaatttaatgtatttggctgctattgctgattcccaaccgcaaacacctgctgcacatgcccagatcgcatccaatgcaatgcttcaagcaggtggtcattatatgcagcaccagcagacagtaactccccagtcacttcttgctgcaaggtcatctatgctttacagtcagcaacctatgactgcattccatcaagcacagcagcagcagcaacaacaatctctccatggccagttggggataaattcaggaggaaacaatggattacatattcttcatggtgaaacaagcatgggtagtaatggacctctcacgacaggaagctttcctgattttgggcgaggttcagtaaattgtgatctattgcagggcaataggagcttgactattgaccgtggctctagcaagattgatgggcttggaacagagaatacgcaccctgtagaagggcgaggaggagcaagtgtgggccaaaacacagaagaaggggcaccatcttatttgaaagcttctgaggatgagggaagctag

SEQ ID NO: 186 - protein, 232 aa, Welwitschia mirabilis
MQMQPMIGAGYSSNSITTDHIQKYLDENRQLILAILDNQNLGKLNECAQYQARLQQNLMYLAAIADSQPQTPAAHAQIASNAMLQAGGHYMQHQQTVTPQSLLAARSSMLYSQQPMTAFHQAQQQQQQQSLHGQLGINSGGNNGLHILHGETSMGSNGPLTTGSFPDFGRGSVNCDLLQGNRSLTIDRGSSKIDGLGTENTHPVEGRGGASVGQNTEEGAPSYLKASEDEGS

SEQ ID NO: 187 - DNA, 684 bp, Zea mays
atgcagcagcaacacctgatgcagatgaaccagaacatgatggggggctacacctctcctgccgccgtgaccaccgatctcatccagcagcacctggacgagaacaagcagctgatcctggccatcctcgacaaccagaacaatggcaaggcggaggagtgcgaacggcaccaagctaagctccagcacaacctcatgtacctggccgccatcgctgacagccagccgccacagaccgcgccactatcacagtacccgtccaacctgatgatgcagccgggccctcggtacatgccaccgcagtccgggcagatgatgaacccgcagtcgctgatggcggcgcggtcctccatgatgtacgcgcacccgtccctgtcgccactccagcagcagcaggcggcgcacggacagctgggtatggctccagggggcggcggtggcggcacgaccagcgggttcagcatcctccacggcgaggccagcatgggcggtggtggtgctggcgcaggcgccggcaacaacatgatgaacgccggcatgttctcgggctttggccgcagcggcagtggcgccaaggaagggtcgacctctctgtcggttgacgtccggggtggaaccagctccggcgcgcagagcggggacggcgagtacctcaaagtcggcaccgaggaagaaggcagttag

SEQ ID NO: 188 - protein, 227 aa, Zea mays
MQQQHLMQMNQNMMGGYTSPAAVTTDLIQQHLDENKQLILAILDNQNNGKAEECERHQAKLQHNLMYLAAIADSQPPQTAPLSQYPSNLMMQPGPRYMPPQSGQMMNPQSLMAARSSMMYAHPSLSPLQQQQAAHGQLGMAPGGGGGGTTSGFSILHGEASMGGGGAGAGAGNNMMNAGMFSGFGRSGSGAKEGSTSLSVDVRGGTSSGAQSGDGEYLKVGTEEEGS

SEQ ID NO: 189 - DNA, 549 bp, Zea mays
atgcagcagccgatgcacatgcagccacaggcgccggcgataaccccagctgccggaatcagcacggagcagatccaaaagtatctggatgagaataagcagcttattttggctattttggaaaatcagaacctaggaaaattggcagaatgtgctcagtatcaatcacaacttcagaagaacctcttgtatctcgctgcaatcgcagatgctcaaccgcagactgctgtaagccgccctcagatggcgccgcctggtggatcgcctggagtagggcagtacatgtcacaggtgcctatgttcccaccgaggacacctcttacaccccagcagatgcaggagcagcagcttcagcagcagcaggctcagttgctaaacttcagtggccaaatggttgctagaccaggcatggtcaacggcatggctcagtccatgcaagctcagctaccaccgggtgtgaacaagcaggatgctggtggggtcgcctctgagccctcgggcaccgagagccacaggagcactggtggtgacgatggtggaagcgactag

SEQ ID NO: 190 - protein, 182 aa, Zea mays
MQQPMHMQPQAPAITPAAGISTEQIQKYLDENKQLILAILENQNLGKLAECAQYQSQLQKNLLYLAAIADAQPQTAVSRPQMAPPGGSPGVGQYMSQVPMFPPRTPLTPQQMQEQQLQQQQAQLLNFSGQMVARPGMVNGMAQSMQAQLPPGVNKQDAGGVASEPSGTESHRSTGGDDGGSD

SEQ ID NO: 191 - DNA, 663 bp, Zea mays
atgcagcagcagatgcccatgccgccggcgcccgctgccgccgcggcggcggcgcccccggcggcaggcatcactaccgagcagatccagaagtatttggacgaaaataagcaacttattttggccatcctggaaaatcagaacttagggaagttggctgaatgtgctcagtatcaagctcaacttcaaaagaacctcttgtacctggctgcgattgctgatgcccaaccccagcctccgcaaaaccctgcaggtcgccctcagatgatgcagcctggtatagtgccaggtgcggggcattacatgtcacaagtaccaatgttccctccaagaaccccattaaccccacagcagatgcaggagcagcagcaacaacaacagtttcagcagcagcagcagcaagtgcaggctcttacatttcctggacagatggtcatgagaccaggcaccatcaacggcatgcagcagcagcagcctatgcaggctgaccctgcccgggcagcagcggagctgcagcaggcagcacctatcccagctgacgggcgaggaagcaagcaggacaccgcgggtggggcgagctcagagccttctgccaatgagagccacaagagcgccaccggagcagataccgaggcaggtggcgacgtggccgagaaatcctaa

SEQ ID NO: 192 - protein, 220 aa, Zea mays
MQQQMPMPPAPAAAAAAAPPAAGITTEQIQKYLDENKQLILAILENQNLGKLAECAQYQAQLQKNLLYLAAIADAQPQPPQNPAGRPQMMQPGIVPGAGHYMSQVPMFPPRTPLTPQQMQEQQQQQQFQQQQQQVQALTFPGQMVMRPGTINGMQQQQPMQADPARAAAELQQAAPIPADGRGSKQDTAGGASSEPSANESHKSATGADTEAGGDVAEKS

SEQ ID NO: 193 - DNA, 1173 bp, Homo sapiens
atgggcggcaacatgtctgtggctttcgcggccccgaggcagcgaggcaagggggagatcactcccgctgcgattcagaagatgttggatgacaataaccatcttattcagtgtataatggactctcagaataaaggaaagacctcagagtgttctcagtatcagcagatgttgcacacaaacttggtataccttgctacaatagcagattctaatcaaaatatgcagtctcttttaccagcaccacccacacagaatatgcctatgggtcctggagggatgaatcagagcggccctcccccacctccacgctctcacaacatgccttcagatggaatggtaggtgggggtcctcctgcaccgcacatgcagaaccagatgaacggccagatgcctgggcctaaccatatgcctatgcagggacctggacccaatcaactcaatatgacaaacagttccatgaatatgccttcaagtagccatggatccatgggaggttacaaccattctgtgccatcatcacagagcatgccagtacagaatcagatgacaatgagtcagggacaaccaatgggaaactatggtcccagaccaaatatgagtatgcagccaaaccaaggtccaatgatgcatcagcagcctccttctcagcaatacaatatgccacagggaggcggacagcattaccaaggacagcagccacctatgggaatgatgggtcaagttaaccaaggcaatcatatgatgggtcagagacagattcctccctatagacctcctcaacagggcccaccacagcagtactcaggccaggaagactattacggggaccaatacagtcatggtggacaaggtcctccagaaggcatgaaccagcaatattaccctgatggaaattcacagtatggccaacagcaagatgcataccagggaccacctccacaacagggatatccaccccagcagcagcagtacccagggcagcaaggttacccaggacagcagcagggctacggtccttcacagggtggtccaggtcctcagtatcctaactacccacagggacaaggtcagcagtatggaggatatagaccaacacagcctggaccaccacagccaccccagcagaggccttatggatatgaccagggacagtatggaaattaccagcag

SEQ ID NO: 194 - protein, 391 aa, Homo sapiens
MGGNMSVAFAAPRQRGKGEITPAAIQKMLDDNNHLIQCIMDSQNKGKTSECSQYQQMLHTNLVYLATIADSNQNMQSLLPAPPTQNMPMGPGGMNQSGPPPPPRSHNMPSDGMVGGGPPAPHMQNQMNGQMPGPNHMPMQGPGPNQLNMTNSSMNMPSSSHGSMGGYNHSVPSSQSMPVQNQMTMSQGQPMGNYGPRPNMSMQPNQGPMMHQQPPSQQYNMPQGGGQHYQGQQPPMGMMGQVNQGNHMMGQRQIPPYRPPQQGPPQQYSGQEDYYGDQYSHGGQGPPEGMNQQYYPDGNSQYGQQQDAYQGPPPQQGYPPQQQQYPGQQGYPGQQQGYGPSQGGPGPQYPNYPQGQGQQYGGYRPTQPGPPQPPQQRPYGYDQGQYGNYQQ

SEQ ID NO: 195 - DNA, 609 bp, Physcomitrella patens; identical to SEQ ID NO: 129

SEQ ID NO: 196 - protein, 202 aa, Physcomitrella patens; identical to SEQ ID NO: 130

SEQ ID NO: 197 - DNA, 552 bp, Chlamydomonas reinhardtii; identical to SEQ ID NO: 75

SEQ ID NO: 198 - protein, 183 aa, Chlamydomonas reinhardtii; identical to SEQ ID NO: 76

SEQ ID NO: 199 - DNA, 261 bp, Micromonas sp. RCC299
atgtcgactccggttcaggctcacgggaacgccgccgagaaggtgatcacgacggagcttattcaaaaatacctcgatgagaaccagacgctcatcctggccatcctggagaaccagaacgtgggcaagctggaggcgtgcaaccagtaccaggcgaggctgcagcagaacctgatgtacctggcggcgatcgcggacgcgcagccgcccccaaagccgggggcgaacgcggcacagggcggagcgggggcggcccaatga

SEQ ID NO: 200 - protein, 86 aa, Micromonas sp. RCC299
MSTPVQAHGNAAEKVITTELIQKYLDENQTLILAILENQNVGKLEACNQYQARLQQNLMYLAAIADAQPPPKPGANAAQGGAGAAQ

SEQ ID NO: 201 - DNA, 243 bp, Ostreococcus lucimarinus
atgtctggcgaacaagccggtccttcatttgtgacgcccggcgacgccgccgcgccgtccgtggtgacgacggagctgatacaaaagtatttggatgagaatcagcaactgattctcgcgatccttgagaatcaaaacgtcggcaagctcgcggagtgcgccaagtatcagaccaaactgcaggaaaacttgatgtacctagccgccatagcggatgcgaagccggcggagccgtcggaatag

SEQ ID NO: 202 - protein, 80 aa, Ostreococcus lucimarinus
MSGEQAGPSFVTPGDAAAPSVVTTELIQKYLDENQQLILAILENQNVGKLAECAKYQTKLQENLMYLAAIADAKPAEPSE

SEQ ID NO: 203 - DNA, 1215 bp, Glycine max
atggggaagaaaacagagctgaaagatcacaaggagatagccaaagttgaaactgttcttgagcttctcaggaaacaaacccctctcactgtgaaacaggagaagttttgcaactatgcttgtgtgaaacggtttctgaaagcaaaaggggatagtgtgaaaaaagcttcgaagcaactcaaggcttgtcttgcttggagagagagtgttatcgctgatcacttgatagcagatgatttctcagctgaactggctgatgggttggcctatttggctggtcatgatgacgaatccagacctgttatgatttttcgtttgaagcaagattatcaaaagttgcattcccagaagatgttcactcgtttgctggcctttacaatagaggtggccatttcgaccatgccaaaaaacgtagaacaattcgtgatgctttttgacgcaagcttttacagatcagcatctgctttcatgaacctattactaccagcactgaaaattgtggcggagtactacccaggaaggctatgcaaagcgtttgtcatagaccctccctcgcttttcgcttacttgtggaagggtgtgaggccgttcgtggaattatcatcatggacgacggtggtatcatcgttggatttcgaagaatcgttggacttcaacgacttcgcggcgtacccgcgagcctcgtccctccgattcgacagcgcgagcgtgaaatcaacggcgaagataggctcgtgctcctcgtcacggttctccttcaccgtatctcaccaccttgactcgttgaagccctggtacctgagcctggccgacacgtcagcatccaaagtgggacccacgagtccttcggccgcactcatctcgccgctgaacgcgcgctcgctctcgttcgcgtcgcccgtcgcgagaaccccccgaggccccccggccaccaggaagggcctcttcccctcaacgccgctgccgcagcgcgtgacggcgccgccgcggacctcgttcctccagtcgccggcgacgttcttcaggcgagatagccacgttgccgccaagggagagaggtgccgggaatcgttcttgccgtatgtgaagttctaccgaagaccatacgacgaaatggtgtataggtcaaagatgcggcccccactcggcggcctaatctccattgtttcccctcatatcacaagacgccatgtttccgtttctcagcgtttctaa

SEQ ID NO: 204 - protein, 404 aa, Glycine max
MGKKTELKDHKEIAKVETVLELLRKQTPLTVKQEKFCNYACVKRFLKAKGDSVKKASKQLKACLAWRESVIADHLIADDFSAELADGLAYLAGHDDESRPVMIFRLKQDYQKLHSQKMFTRLLAFTIEVAISTMPKNVEQFVMLFDASFYRSASAFMNLLLPALKIVAEYYPGRLCKAFVIDPPSLFAYLWKGVRPFVELSSWTTVVSSLDFEESLDFNDFAAYPRASSLRFDSASVKSTAKIGSCSSSRFSFTVSHHLDSLKPWYLSLADTSASKVGPTSPSAALISPLNARSLSFASPVARTPRGPPATRKGLFPSTPLPQRVTAPPRTSFLQSPATFFRRDSHVAAKGERCRESFLPYVKFYRRPYDEMVYRSKMRPPLGGLISIVSPHITRRHVSVSQRF

SEQ ID NO: 205 - DNA, 1218 bp, Medicago truncatula
atggggaagaaacttgaactcctcaaagacaaggaaactgctaaagttgaagctgttcttgaactcatcagaaaacaaacccctctcactgtcaaacaggaaaagttctgcaactatgcttgtgtgaaacggtttctgaaagtgaaaggagataatgtgaaaagagctgctaaacaactaagagcttgtctttcatggagagaaagtattgttactgatcaattgatagcagatgatttctcagctgaattatctgaagggttggcttatgtggctggtcatgatgatgaatccagacctgttttgattttccgcatgaaacaagactatcagaagttgcattctcagaaactgttcttcactcgtttattggctttcacaatggaagtggcaatttcaaacatgccaaaaaatgttgaacaatttgtcatgcttttcgatgcaagcttttacagatcagcatctggatttatgaacttgttgttgggagcattgaaaattgtgggtgagtactatccaggacggttaagcaaagcatttgtgatagaccctccatcactttttgcatacttgtggaagggtgttcgtccattcgttgagctatcaacatgcacaacaatagtatcatccctagatttcgaaccatcaatggactacaacgacttctcaacttacccaagagcctcatcactcagattcgatcaatcaacggcgaagatcggttcatgctcatcctcacgcttctccttccaagtctcacaccaactcgactcactgaaaccatggtaccttagcctaggaggagacaacacatcatcctccaaagtaggacccactagcccatcccttacaccactcaacgctcgctcactctcattcgcttcaccaatagcacgcaacccactgggcccaccagctagcaggaaggggttgttcccttcaacaccactgccgcagagagtgactactgctcctaaccggactacggcggcgtcgtttcttcagtctccggcgacgtttttcaggcgggatagggataatgtgaaggtggaaagaggtagagaaacatttttggcgtatgtgaaattctatagaagggcgtatgatgaaatggtttataggtcaaagatgaggcccccacttggtggattagtctccattgtttcacctcatcttagacgccgtcacactcacctttctgtttctcagcgtttctaa

SEQ ID NO: 206 - protein, 405 aa, Medicago truncatula
MGKKLELLKDKETAKVEAVLELIRKQTPLTVKQEKFCNYACVKRFLKVKGDNVKRAAKQLRACLSWRESIVTDQLIADDFSAELSEGLAYVAGHDDESRPVLIFRMKQDYQKLHSQKLFFTRLLAFTMEVAISNMPKNVEQFVMLFDASFYRSASGFMNLLLGALKIVGEYYPGRLSKAFVIDPPSLFAYLWKGVRPFVELSTCTTIVSSLDFEPSMDYNDFSTYPRASSLRFDQSTAKIGSCSSSRFSFQVSHQLDSLKPWYLSLGGDNTSSSKVGPTSPSLTPLNARSLSFASPIARNPLGPPASRKGLFPSTPLPQRVTTAPNRTTAASFLQSPATFFRRDRDNVKVERGRETFLAYVKFYRRAYDEMVYRSKMRPPLGGLVSIVSPHLRRRHTHLSVSQRF

SEQ ID NO: 207 - DNA, 1317 bp, Oryza sativa
atggccatggagaaggtggacgccaaggagagggagaagatcgaggccgtccgcaagaccctccgcaagcaggctccgctcaccgccaagcaggcgatgtactgcaacgacgcgtgcgtggagcggttcctccgggcgagaggggagagcgtgaagaaggcggcgaaacacctgagaaccgtcctgtcctggagggacaccatcggagccgatcacatcatcgccgacgagttctccgccgagctggctgacggcgtcgcctacgtcgccggccacgacgacgaggcccgacctgtcgtggtctttcgaatcaagcaggactacccaaagttccactcccagaaatcgttcgtgcggttactggtgttcacgctggaggtggccgtgtcatgcatgtcccgcttcgtcgaccagttcgtcctcctcttcgatgcaagctttttccggtcggcgtcggctttcctcaacctgctcatgggcacgctcaagatcgtcgccgactactaccccggccgcctccaccgcgccttcgtcatcgacccgccgtccctcttctccgtcctctggaagggagtgaggccgttcgtggagctggcgccggcgacggcggtggtgtgctcgctggacttcgaggactcgctggaggacgcgtcgttcacggcgtacccgcggacggcgtcgctgcggttcgagccggcggcggccctgctggcgaccgggacgaagggcatcggcgtcggctccgcctcgtcgcggttctccgtcaccgtgtcgcacgacaacaccctcaagccgtggtacctgtccaccaccacgccgtcgtcggtggggcctcgctccgtggtgccgacctccagcccgtccctcatcggcgcgtcgccgctctcggcgcgctccttctccttcgcctcccccgccgcgcgctccaccacgacgccgcccgtccaccgcggcgcaccgctgacgccgttctcgaccaagggcgggcagaaggcgccggcgccagcgcagcagttcccgcggacgccgcggccgtcgttcctgcagtcgccgtcgatgctgttcgcgttcaagaaggacggccaggccagccgcggcgagcgggagcgcgagtccttcctgccgttcctccgcttctaccgccgcccctacgacgagatatcgtatcgcgccaagatgcggccgccgctgggcgggctcatcgccatcgtcgacgagaagtcgaagcagcacaagacggtgcagccgccgctgcgacggcacgccgggctccaccaccagcagctgttccagctccaccaccaccagaggatctga

SEQ ID NO: 208 - protein, 438 aa, Oryza sativa
MAMEKVDAKEREKIEAVRKTLRKQAPLTAKQAMYCNDACVERFLRARGESVKKAAKHLRTVLSWRDTIGADHIIADEFSAELADGVAYVAGHDDEARPVVVFRIKQDYPKFHSQKSFVRLLVFTLEVAVSCMSRFVDQFVLLFDASFFRSASAFLNLLMGTLKIVADYYPGRLHRAFVIDPPSLFSVLWKGVRPFVELAPATAVVCSLDFEDSLEDASFTAYPRTASLRFEPAAALLATGTKGIGVGSASSRFSVTVSHDNTLKPWYLSTTTPSSVGPRSVVPTSSPSLIGASPLSARSFSFASPAARSTTTPPVHRGAPLTPFSTKGGQKAPAPAQQFPRTPRPSFLQSPSMLFAFKKDGQASRGERERESFLPFLRFYRRPYDEISYRAKMRPPLGGLIAIVDEKSKQHKTVQPPLRRHAGLHHQQLFQLHHHQRI

SEQ ID NO: 209 - DNA, 2016 bp, Physcomitrella patens
atggatcaatggcaagtgtgtgttacttatcatgtcgatgcgggctgtgctattaacgccattagaatcatgtcaatgcggaacttgtcatttataaggcgggatgaggtgccgatcgcatgcttgactggttttggtgaccgtcttttcgtggtggtgtcggtttctgttttggctgtgggttgttttcttgtcaactgttgtgccactttcccgagctgtgatcgttacgggcggcgttgcggaagatattgtgtttttggttgcgtttgcgttgcgatggagtgtcttgttgatagcagctttttgttgatggtgctgctgaatgttgtcagatcgttgatgtgtgtacgagttgcgggtcgggggaggtcattattattggttcctggtacttttatctcttcctggtgctgcgatgcttggctttcttgcatactgacggtcaactttctagaatggcactctgggcttagcgcagtgccaaaggcagtggaggaggttcctagaggacaccggagttgtgtaggagggctagagtgggattcatttggggacattggagcgacgcgggaaaatagaagggatagtttggaagtaaggaacatggagcaggaactagttgcagtggctgcttcccctgctaaagtggagccagaatcgactacaaaggagaagcggaaagaagtgctacagctcgtccaaaaagataacccccttaccaagaaagagttggacttttgtgatgacgcctgcgtagaccggtatttaaaagcttgtggaaacagtgtgcggcgggctgcgagaatgctcaaagctacccttaactggcgtgacaaaatcgaaattggctacatgatagcggacgaatttccagctgacatagccgcaggatctgcttatgtagctggtcatgacgaagacggtcgaccagtcttggttatcaagaggaagcccgatcacatcttgaatcatactcaaaaacaatatcttcgatatctgatcttcacaatggaagtagcgctggctgcaatggctccaggagtttatcaatgggtgcttatttttgatgctcgaggatattcaaaagctagcgctccatcacctagtggcattctcacgactttgaagatactctcagatcattatccagagaggctggcgaaggctttcattgtagatgcttcatccatgttttatcatatttggaaggggatgtgtacttttgttgaccatcccacgagagggaaattacattttgcctacaccaaagattacaaaggaactttaaaatcacagcagagctccaaagctgttcctttgtctccgtcttctgacagtgctccgcgaagatcatcaaatgcttgtgccgacgatttcaaatatcttacgtctcctcagtccactgtacaaggccgaaatgacatatctctaccaacagtttatgatgctagtccgaagaacaattgtcaagggcaaactcgtggcaagctgtcagatggccctgaattaattcacagtgttcggacaagatctttctcattctcctcgatcattaccatgtcttacactgcacctgaaccacgagatggtgaatcctctagttttaggaaagaaccagaagagatagttgacgaaccaaaagttgtggtcacgtcatctgttagaccaaaactcaccagagcaccctgggatggccttgtttccatattttactcgcagaagaaggacgaacacaagaagcagaatctttcacggaaggaggaagaacccgtggcattggacgaaccgacgaaggatgaattcaaaaaagaggaacacagaaaagacgacaacgtgaaagaagaacagaggagggatgaacagaaaattaggtccctagattcttttctgccatacttaagttttgtccaggaaccttacaatgaagaatcatatagggcattgatgaagcctccccttggtgggctggccatgataatttctactgaactaaacagtatggacagcttctaa

SEQ ID NO: 210 - protein, 671 aa, Physcomitrella patens
MDQWQVCVTYHVDAGCAINAIRIMSMRNLSFIRRDEVPIACLTGFGDRLFVVVSVSVLAVGCFLVNCCATFPSCDRYGRRCGRYCVFGCVCVAMECLVDSSFLLMVLLNVVRSLMCVRVAGRGRSLLLVPGTFISSWCCDAWLSCILTVNFLEWHSGLSAVPKAVEEVPRGHRSCVGGLEWDSFGDIGATRENRRDSLEVRNMEQELVAVAASPAKVEPESTTKEKRKEVLQLVQKDNPLTKKELDFCDDACVDRYLKACGNSVRRAARMLKATLNWRDKIEIGYMIADEFPADIAAGSAYVAGHDEDGRPVLVIKRKPDHILNHTQKQYLRYLIFTMEVALAAMAPGVYQWVLIFDARGYSKASAPSPSGILTTLKILSDHYPERLAKAFIVDASSMFYHIWKGMCTFVDHPTRGKLHFAYTKDYKGTLKSQQSSKAVPLSPSSDSAPRRSSNACADDFKYLTSPQSTVQGRNDISLPTVYDASPKNNCQGQTRGKLSDGPELIHSVRTRSFSFSSIITMSYTAPEPRDGESSSFRKEPEEIVDEPKVVVTSSVRPKLTRAPWDGLVSIFYSQKKDEHKKQNLSRKEEEPVALDEPTKDEFKKEEHRKDDNVKEEQRRDEQKIRSLDSFLPYLSFVQEPYNEESYRALMKPPLGGLAMIISTELNSMDSF

SEQ ID NO: 211 - DNA, 1284 bp, Populus trichocarpa
atgggcaagaaagaacagcaacttcaaccacagaaagatcacaaagacaatgatagaggtgaagctgttctcgagcttctaagaaaacatgctccactcactgttaaacaggagaagttctgcaacaatgcttgtgtggagaggtttctaagagcaaaaggtgataatgtgaagaaagctgctaagcacttaagggcctgcctttcttggagagagagtataggcactgagaatttgatagcggatgagttctcagctgagctagctgaaggagttgcttatgttgctggtcatgatgaagaatccagacctgttatgatttttcgaatcaagcaagattaccaaaagttccattcacaaaaactgttcactcggttgctagtgtttacactggaggtggcaatagggaccatgccaagaaacgcagaacaatttgttctcctctttgatgcaagctttttcaggtcagcatcggcttttatgaatttattgctcggaactctgaaaattgtggctgagtactacccaggcaggctttacaaggcttttgtaatcgacccgccttctctcttcccttatttatggaagggtgtccgtccatttgttgagctatcaacggccacgatggtggtatcttcactagactttgaagaatcactggagttcaatgacttttcctcctaccctcgagcctcctccctccgattggatccttcgtctgtcaagtcaacggctaagattggctcatgctcttcctctagattttccttcaccgtgtcccaccattttgactccctcaagccttggcacctaactttgactgacacgtcggcatcaaaagtaggaccaacaaacctctcttctctgggcccggccctcatctctcccctcaacgctagatccttttcttttgcgtcaccagttgccagaaccccacgtggcagcatgaacggtggcagctacactaggcttgcccagaaaagtctcttcccatcaaccccgttgccacagcgtgtcaccacgagtgacacactcaaaatctctcaaccgcggaccccacgcccctcgttcctccaatcacctgccttgtttttcaagaaggagtgccacgtcagcaaggcagacaggtctcgagaatcgttcgtgccatttttgaagttttataggaggccgtacgatgagatgatttataggtcaaagatgcggcctccactcgggggactcatatccattgtctcgcctcacatcaaacggcgccacatgtcagtatctcaacggttttaa

SEQ ID NO: 212 - protein, 427 aa, Populus trichocarpa
MGKKEQQLQPQKDHKDNDRGEAVLELLRKHAPLTVKQEKFCNNACVERFLRAKGDNVKKAAKHLRACLSWRESIGTENLIADEFSAELAEGVAYVAGHDEESRPVMIFRIKQDYQKFHSQKLFTRLLVFTLEVAIGTMPRNAEQFVLLFDASFFRSASAFMNLLLGTLKIVAEYYPGRLYKAFVIDPPSLFPYLWKGVRPFVELSTATMVVSSLDFEESLEFNDFSSYPRASSLRLDPSSVKSTAKIGSCSSSRFSFTVSHHFDSLKPWHLTLTDTSASKVGPTNLSSLGPALISPLNARSFSFASPVARTPRGSMNGGSYTRLAQKSLFPSTPLPQRVTTSDTLKISQPRTPRPSFLQSPALFFKKECHVSKADRSRESFVPFLKFYRRPYDEMIYRSKMRPPLGGLISIVSPHIKRRHMSVSQRF

SEQ ID NO: 213 - DNA, 1314 bp, Zea mays
atggccatcgacaaggtggacgccaaggagagggagaagatcgaggccgtacgcaagctgctgtgcaagcaggcgccgctctccgcgaagcaggcgcagtactgcaacgacgcgtgcttggagcggttcctgcggtcgcggggggacagcgtcaagaaggcggcgaagcacctgaggaccgtcctctcatggagggagagcgtcggagctgatcacatcatggccgacgagttctccgccgagctcgccgacggcgtggccttcgtctccggccacgacgacgacggccgcccagtcgtggtgtttcgaatcaagcaggactaccccaagttccactctcagaaatcgttcgtgcgcctgctggtgttcacgctggaggtggccgtggcgtgcatgtcccggttcgtggaccagttcgtcgtcctcttcgacgcaagctttttccgctcggcgtcggctttcctcaacctactcatgggcacgctcaagatcgtcgccgactactaccccggccgcctccaccgcgccttcgtcatcgacccgccctccctcttctccgtcctctggaagggggtgcggccgttcgtggagctggcgccagcgacggcggtggtgtgctccctggacttcgaggactcgctcgaggacgcgtctttcacggcgtacccgcggaccgcgtcgctgcggttcgagccggcggccgtcgtggggaagaacccgggcgtggggtcggtctcgtcgcggttctccgtcacccccaccgacaaccccatcaagccgtggtacctctccaccatccccacctcggtgggctcccgctccgtggtgcccacctccagcagcccgtcgctggtcggcgcgtccccgctctccgcgcgctccttctccttcgcctcgcccgccacgctgcgctccacggtcgccacgccgccgccgttcccgcgcggcgcgggcgcgcccctgacgccgtcctccgccgccaaggcccagaagaccccgccgcagccgcagcagttcccgcggacgccgcgcccgtcgttcctgcagtcgccgtcgatgctgttcgcgttccggaaggacgggcaggccagccgcgtggagcgcgagcgcgagtccttcctcccgtacctgcgcttctaccgccggccctacgacgagatttcctaccgcgccaagatgcgccccccgctcggcggcctcatatccatcgtcggcgacaagttcaggcagaagccggtgccgcagccgcagccgctgcgtcgccacgctgggctccaccaccagcaccattaccagcagcagcagaggatctga

SEQ ID NO: 214 - protein, 437 aa, Zea mays
MAIDKVDAKEREKIEAVRKLLCKQAPLSAKQAQYCNDACLERFLRSRGDSVKKAAKHLRTVLSWRESVGADHIMADEFSAELADGVAFVSGHDDDGRPVVVFRIKQDYPKFHSQKSFVRLLVFTLEVAVACMSRFVDQFVVLFDASFFRSASAFLNLLMGTLKIVADYYPGRLHRAFVIDPPSLFSVLWKGVRPFVELAPATAVVCSLDFEDSLEDASFTAYPRTASLRFEPAAVVGKNPGVGSVSSRFSVTPTDNPIKPWYLSTIPTSVGSRSVVPTSSSPSLVGASPLSARSFSFASPATLRSTVATPPPFPRGAGAPLTPSSAAKAQKTPPQPQQFPRTPRPSFLQSPSMLFAFRKDGQASRVERERESFLPYLRFYRRPYDEISYRAKMRPPLGGLISIVGDKFRQKPVPQPQPLRRHAGLHHQHHYQQQQRI

SEQ ID NO: 215 - DNA, 4638 bp, Glycine max
atgacgtctcggcagctgcactctacaatgctttactttgtctttctgtctgcaccagtgaatattattgtaggttctcatgtctggattgaagatccagcacaagcatggattgatggagaagtttctaaaatcaatggtgaagaagtccatgttcgcaccacagatggaaaaacagttgtcaaaaatatctcaaaggtttttcccaaggataatgaagcccctcctggtggtgtagatgacatgacaaaattgtcttacttgcatgaaccaggagttctgcacaatttggcaactagatatgaactcaatgaaatctatacatatactggaaatatcttgattgcaataaatccttttcaaagattaccgcatctatatgatactcacatgatggaacaatacaaaggagctgcatttggagaattgagtccccatgtttttgcagttgcagatgttgcatacagggcgatgattaatgagggaaaaagcaactcaatcctggttagtggtgagagtggggctggaaagacagagacaacaaaaatgcttatgcggtatcttgcatatcttgggggccgatctggagtagaaggaaggacagttgaacaacaagttctagaatctaatccagttcttgaagcatttggcaatgccaaaacagttagaaacaacaactcaagtcgttttggaaaatttgttgagatacaatttgacaacaaaggaagaatctctggggcagctatacggacatatttgcttgaaagatcccgtgtctgtcaactttcggatcctgaaagaaattaccattgtttttaccttctctgtgcagcaccagctgaggaaaaagagaagtataagctgggaagtcctagctcctttcattacttaaatcaatccaaatgctatgcgctggatggagtggatgatgctgaagaatatcttgcaactcgaagggcaatggatgttgttggaatcagtgaggaggagcaggaggctatttttagggttattgcagcaattttgcaccttggaaatattgaatttgcaaaaggagaggagattgactcttctgtcatcagggacgagaagtctaggttccatcttaatgtaacagctgaacttctaaagtgtgattgtaagagcttggaagatgcactgatcaagcgtgtgatggtaacaccggaggaggttattacaagaacccttgatcctgttgcagctcttggtagcagggatgcattagctaaaaccatttattcccgtttgtttgattggctagtggagaagattaacaattcgattggtcaagatcctaattcaaaatctattattggagttcttgatatctatgggtttgaaagttttaagttcaatagttttgagcagttctgtattaattttacaaatgagaagctgcaacaacattttaatcagcatgtctttaaaatggaacaagaagaatacaccaaagaagagatcgattggagttacatagagtttgttgataaccaagatgttttggatctaattgagaagaaacctggaggaataattgcacttcttgatgaagcctgtatgtttccaaagtctacacatgaaactttttctcagaaattgtaccagacattcaaaaacaacaagcgcttcatcaaacctaaactttctcggactagttttacaatatcccattatgcaggggaggtgacatatctagctgatatgtttcttgacaaaaacaaggattatgtggtggcagaacatcaggatctgctcatagcctcaaagtgctcatttgtggctggtctattccccccttctccagaggagtcttcaaaatcatcaaagttctcttcaataggatctcgcttcaagctgcaacttcaatctttgatggagaccctgaattcaacagaacctcactatatcagatgtgtgaagccgaataatgttctcaagcctgctatttttgaaaatctcaatattatccaacaattgcgctgtggtggtgttcttgaggcaattagaatcagctgtgctggatatcctaccagacggaccttttatgaatttcttaacagatttggtgttcttgcccctgaagttctggacggaaactatgatgacaaggttgcgtgccaaatgatcctggataaaatgggtatgaaaggctatcagataggcaagacaaaggttttcttaagagctggccagatggctgaattggatgcaagaagagcagaggttcttggaaatgctgctagaatcatccagaggcaagtacgtacccatattgcacgcaaggagttcattgaattgcgccgagctgcaatttgcttgcaatctaatttacgaggaatattgtcccggaaactttatgagcagttgcgacgtgaagcaggagctgtaaaaatacaaaagaacttcaaaggatacattgccaggaaatcatacttaacagggcgatcatctgcagttatactgcaaacaggtttaagggctatgaaagctcgtgatgaatttagatttagaaagcaaacgaaggctgcaatttacatccaggcttatttgcgtcggctaattgcatattcatattataaaagattgcaaaaggctgcagttgttactcaatgtggttggaggagaaggattgctagaagggaacttagaatgcttaaaatggctgctagagaaacaggggccctcaaagaagctaaggacaaactagaaaagcgtgttgaagaacttacttggcgtttgcaaattgagaaacgtttgagaactgatttggaagaggaaaaggcacaagaaattgctaagttacaggaagctttacatgcaatgcaaatacaagtagaagaagcaaataccaaggtcatcaaagagcgcgaggcagcacgaaaggccattgaagaagcacctccagttgttaaggagactcctattataattcaagatactgaaaagattaattcattattggctgaagtcaatagtttgaaggaatcactcctattggaaaaagaggctaaagaagaggccagaaaagctcaggctgaggctgaagctagaaataaagagatggttaaaaaggttgaagattctgaccgcaaagtggatcaacttcaagaattggttcagagattggaggaaaagatttccaatgcagagtcagaaaatcaagttcttcgccagcaagcactggctgtatcaccaactggaaaaactctgtctgcaagaccaaggacagtgattattcagaggacacccgaaaatgggaatgctctaaatggtgaagcaaaaattggatcggatatgactcttgctgtatccaatgtgcgtgagcctgaatctgagggaaaaccacaaaaatctctcaatgagaagcagcaagaaaaccaggacttattgatcaagtgcataacacaagatttgggattttctgggggcaaacctgttgctgcatgtgtcatatataaatgccttctccactggaggtcatttgaagttgaaaggactagtgtattcgaccgtatcattcaaacaatagcttcagctgttgaggcccaggataatactgatgttttagcctattggttgtctaatacatctactttgttgttgctactccaacgcactcttaaagctagtggagctgctagcttaacaccacagcggcggagaacagcatcatcttctctgtttggaagaatgtctcaagggctaagggcgtctccccaaagtgctggattgtcatttctaaatggtcgaggtcttaatagactggatgatttacgacaagtagaagcaaaatatccagcactgctgtttaagcagcagcttactgccttccttgaaaaaatatatggaatgataagagacaacctaaaaaaggagatatctccattacttggactttgtatacaggctccaagaaactcgcgtcaaagtctagtaaaaggacgcgcacaggcaaatgcagttgctcagcaagccttaattgctcactggcaaagtattgtgaaaagcttaaacaattatctaaagataatgaaagcaaactatgcgcctcctttcttggtccgaaaagtgttcactcaaatattctcattcatcaatgttcaattattcaatagtcttctgttgcgtcgggagtgttgttcgttcagcaatggggagtatgtaaaaacaggtctggctgaattagagcagtggtgcatcgaggcaacagaggagtatactggctctgcttgggaggaactgaaacatatcaggcaggctgttggattcctggtgatacatcaaaaacccaaaaaatccctgaatgaaattacaaaggagctttgccctgttctcagtatacaacagttatacaggataagtacaatgtactgggatgacaaatacggcactcacagtgtgtctacagacgttataacaaacatgagagctatgatgtctgaggactctaataatgctgtcagcacttctttcctattagatgatgactcgagcattcctttttcggtggatgacatttccaaatcaatgcacccagtagaagtagcagacgtggatcctcctccgttgatacgtgagaactcagggtttgggttcttactagcacggtcagagtga

SEQ ID NO: 216 - protein, 1545 aa, Glycine max
MTSRQLHSTMLYFVFLSAPVNIIVGSHVWIEDPAQAWIDGEVSKINGEEVHVRTTDGKTVVKNISKVFPKDNEAPPGGVDDMTKLSYLHEPGVLHNLATRYELNEIYTYTGNILIAINPFQRLPHLYDTHMMEQYKGAAFGELSPHVFAVADVAYRAMINEGKSNSILVSGESGAGKTETTKMLMRYLAYLGGRSGVEGRTVEQQVLESNPVLEAFGNAKTVRNNNSSRFGKFVEIQFDNKGRISGAAIRTYLLERSRVCQLSDPERNYHCFYLLCAAPAEEKEKYKLGSPSSFHYLNQSKCYALDGVDDAEEYLATRRAMDVVGISEEEQEAIFRVIAAILHLGNIEFAKGEEIDSSVIRDEKSRFHLNVTAELLKCDCKSLEDALIKRVMVTPEEVITRTLDPVAALGSRDALAKTIYSRLFDWLVEKINNSIGQDPNSKSIIGVLDIYGFESFKFNSFEQFCINFTNEKLQQHFNQHVFKMEQEEYTKEEIDWSYIEFVDNQDVLDLIEKKPGGIIALLDEACMFPKSTHETFSQKLYQTFKNNKRFIKPKLSRTSFTISHYAGEVTYLADMFLDKNKDYVVAEHQDLLIASKCSFVAGLFPPSPEESSKSSKFSSIGSRFKLQLQSLMETLNSTEPHYIRCVKPNNVLKPAIFENLNIIQQLRCGGVLEAIRISCAGYPTRRTFYEFLNRFGVLAPEVLDGNYDDKVACQMILDKMGMKGYQIGKTKVFLRAGQMAELDARRAEVLGNAARIIQRQVRTHIARKEFIELRRAAICLQSNLRGILSRKLYEQLRREAGAVKIQKNFKGYIARKSYLTGRSSAVILQTGLRAMKARDEFRFRKQTKAAIYIQAYLRRLIAYSYYKRLQKAAVVTQCGWRRRIARRELRMLKMAARETGALKEAKDKLEKRVEELTWRLQIEKRLRTDLEEEKAQEIAKLQEALHAMQIQVEEANTKVIKEREAARKAIEEAPPVVKETPIIIQDTEKINSLLAEVNSLKESLLLEKEAKEEARKAQAEAEARNKEMVKKVEDSDRKVDQLQELVQRLEEKISNAESENQVLRQQALAVSPTGKTLSARPRTVIIQRTPENGNALNGEAKIGSDMTLAVSNVREPESEGKPQKSLNEKQQENQDLLIKCITQDLGFSGGKPVAACVIYKCLLHWRSFEVERTSVFDRIIQTIASAVEAQDNTDVLAYWLSNTSTLLLLLQRTLKASGAASLTPQRRRTASSSLFGRMSQGLRASPQSAGLSFLNGRGLNRLDDLRQVEAKYPALLFKQQLTAFLEKIYGMIRDNLKKEISPLLGLCIQAPRNSRQSLVKGRAQANAVAQQALIAHWQSIVKSLNNYLKIMKANYAPPFLVRKVFTQIFSFINVQLFNSLLLRRECCSFSNGEYVKTGLAELEQWCIEATEEYTGSAWEELKHIRQAVGFLVIHQKPKKSLNEITKELCPVLSIQQLYRISTMYWDDKYGTHSVSTDVITNMRAMMSEDSNNAVSTSFLLDDDSSIPFSVDDISKSMHPVEVADVDPPPLIRENSGFGFLLARSE

SEQ ID NO: 217 - DNA, 3417 bp, Medicago truncatula
atgactctccgcaagggttccaaggtttgggttcctgacagggattccgcttggcttcctgctgaagtcctcgaatcttccaataaacaacttcgcgttcaaaccgatttcagcaacaagattgttgttgttgctccggagaaactgtttccgagagatgcggatgaagatgaacacggtggagttgaagatatgacgagattgatttatttgaatgaaccaggggttttgtataatattcggagaagatatttgaataatgatatttatacatacacggggagcattttaatagctgtcaatccattcacaaagcttcctcatttgtacaataaccatatgatggagcagtataagggagctccatttggtgagctcagtccacatgtatttgccgttgctgatgcatcatatagagcaatggtgaatgaaggtcaaagccaatctatcttggtcagtggtgaaagtggtgctgggaaaactgagacaacaaaattgattatgcagtatcttacctttgttggtgggcgtgctgtttgtgatgatagaacagttgaacaacaagttcttgaatcgaatccgcttttagaggcatttggcaatgcaaggaccgtcaggaatgacaattcaagccgttttgggaagtttgctgaaattcagtttgattcaagtggtaaaatatctggtgctgcaattagaacttacttattggaaagatcacgagtagtgcagactacggatccagaaagaaattatcactgcttttatcagttgtgtgcatctgaaagggatgtagagaagtacaagttaggacatccaagccacttccactatttaaatcaaagtaaagtttatgaactagatggggtaagcagcgcagaagaatacataaagacgagaagatcaatggatattgttggcatcagtcacgaggatcaggacgccatatttcgcaccttagccgcaatcttacatctgggaaatgttgaattttttcctgggaaagaacacgactcgtcaataataaaggatgagaaatcaatatttcacttgcagatggctgctaaccttttcaagtgtgatctgaacctactgcgagcaacattatgcactcgttcaatacaaacccgtgaaggaaatattgtcaaagctctggattgtaatgccgctgttgctggcagggatgttttggcgaaaaccgtctatgctcgtttgtttgattggcttgttgataagattaataaagcggttgggcaagatatcaattccaggatgcaaattggaatattggatatatatggttttgagtcttttaaggataacagttttgagcaattctgcatcaattttgcaaatgaaaagcttcagcaacattttaatgagcatgtgttcaagatggagcaagaagagtataaaaaagaagaaattgagtggagttacattgaatttatagacaaccaagatgttttagatttgattgaaaagaagcccattggtatcattgccctgttagatgaagcttgcatgtttccaaaatcaacgcacgaaacattctcaaccaagttgtttcagcacttcttgtcccacgctaggtttggaaaggagaagttttcagaaacagattttactgtttctcattatgctggaaaggtcacataccatacagacacttttttagacaaaaatcgtgattatgtagttctagagcattgcaatgtattatcttcctcaaaatgccccttcgtgtcgagtctctttccttctttaccagaagaatcctcaaggtcatcctacaagttttcttctgtggcttccagatttaagcaacaacttcaagcacttatggaaacacttaagacaacagagcctcattatattcgatgtgtcaagccaaattcttcgaacctaccacaaaagtttgaaaatacaagtgtcttgcatcaattacgctgtgggggtgtacttgaggctgttcggataagtctggcaggttacccaactcgaaggacttactcggagtttgtagatcgatttggattaatagctcctgaatttatggatggaagttatgatgatagagctacaactcagaaaatattgcaaaagctaaagcttgagaattttcagctgggtaggactaaagtgtttctcagggctggtcaaattggtattttagactctaggcggtctgaagttttggacaatgctgcgaagtttattcagcgtcgactgcgtacatttattgcacacagggatttcatctcaatccgagctgctgctgtttctcttcaagcatgctgcaggggttgccttgcacggaagatatatgcttctaaacgggagactgcagcagctatctctattcagaagtatattcgtatgtgtcagatgaggtgtgcttacatgacactgtattcttctgctatcatcatacaatcaaatgttcgtggtttcacaattcgccaaaggtttttgcatagaaaagaacacaaagctgctactattattcaggcgtattggaggatgtgcaaggttcggtatgctttcaaacaacttcaattttcaattgtggcaatacaatgcctttggcgctgtaaacaagcaaaaagacagctccgcagactgaaacaagaggctcgtgaagctggtgccttgcgtttagctaagactaatctggagaaacaattggaagagctcacatggcgtttgcatcttgaaaaaaaaaaaagggtttctaatgaagaggctaagcaaattgagatttccaaacttcaaaagatgctggaagctctgaattgtgaattggatggagctaaattggcaactattaatgagtcgaataagaatgcaattttacaaaatcaattacaattatcagcacaggaaaaatctgctttagaaagagaactagttgcaatgaatgaagtgcaaaaggaaaatgctctgctgaagggctctttggatgccatggaaaagaagagcacagctttggagcttgagcttttgaatgctaaaaaagaccataatgaaaccattcagaaaatgagggaatttgaacagaagagtgctcaactagcacaaaatatgaaaagtcttgaagaaaagctatcgagtttggagaatgaaaatcaggtgcttcgtcagaaagccttaagtgtatctcctaagagtaatcatccaggttttgcaaagtcatcatccgaaataaagtcaagggcaatagccccacacattgagcaaaacccagtatttgaatcacctacacccacaaaacttatgtcctctttgacacgtggcttgtcagattctcgtcgatctaaattaacagcagaaaagcatcaggcattactcttgtttcccttgttccgaaatcctacacttttagtttttggcattctgccggaaattgggaaataa

SEQ ID NO: 218 - protein, 1138 aa, Medicago truncatula
MTLRKGSKVWVPDRDSAWLPAEVLESSNKQLRVQTDFSNKIVVVAPEKLFPRDADEDEHGGVEDMTRLIYLNEPGVLYNIRRRYLNNDIYTYTGSILIAVNPFTKLPHLYNNHMMEQYKGAPFGELSPHVFAVADASYRAMVNEGQSQSILVSGESGAGKTETTKLIMQYLTFVGGRAVCDDRTVEQQVLESNPLLEAFGNARTVRNDNSSRFGKFAEIQFDSSGKISGAAIRTYLLERSRVVQTTDPERNYHCFYQLCASERDVEKYKLGHPSHFHYLNQSKVYELDGVSSAEEYIKTRRSMDIVGISHEDQDAIFRTLAAILHLGNVEFFPGKEHDSSIIKDEKSIFHLQMAANLFKCDLNLLRATLCTRSIQTREGNIVKALDCNAAVAGRDVLAKTVYARLFDWLVDKINKAVGQDINSRMQIGILDIYGFESFKDNSFEQFCINFANEKLQQHFNEHVFKMEQEEYKKEEIEWSYIEFIDNQDVLDLIEKKPIGIIALLDEACMFPKSTHETFSTKLFQHFLSHARFGKEKFSETDFTVSHYAGKVTYHTDTFLDKNRDYVVLEHCNVLSSSKCPFVSSLFPSLPEESSRSSYKFSSVASRFKQQLQALMETLKTTEPHYIRCVKPNSSNLPQKFENTSVLHQLRCGGVLEAVRISLAGYPTRRTYSEFVDRFGLIAPEFMDGSYDDRATTQKILQKLKLENFQLGRTKVFLRAGQIGILDSRRSEVLDNAAKFIQRRLRTFIAHRDFISIRAAAVSLQACCRGCLARKIYASKRETAAAISIQKYIRMCQMRCAYMTLYSSAIIIQSNVRGFTIRQRFLHRKEHKAATIIQAYWRMCKVRYAFKQLQFSIVAIQCLWRCKQAKRQLRRLKQEAREAGALRLAKTNLEKQLEELTWRLHLEKKKRVSNEEAKQIEISKLQKMLEALNCELDGAKLATINESNKNAILQNQLQLSAQEKSALERELVAMNEVQKENALLKGSLDAMEKKSTALELELLNAKKDHNETIQKMREFEQKSAQLAQNMKSLEEKLSSLENENQVLRQKALSVSPKSNHPGFAKSSSEIKSRAIAPHIEQNPVFESPTPTKLMSSLTRGLSDSRRSKLTAEKHQALLLFPLFRNPTLLVFGILPEIGK

SEQ ID NO: 219 - DNA, 4590 bp, Oryza sativa
atggggacgaaagttaatattatagtaggttctcatgtttgggctgaagaccctgaaattgcctgggtcgatggagaagttgttaagatcaaaggtgaagaggccgagatccaagcaaccaatggaaagacgatcaccgcaaatttgtcgaaactgtatcctaaagatatggaagcagctgctggtggagttgatgatatgacaaagctatcctacctccatgagccaggagttctgcagaatttggcaaccagatatgaacttaatgaaatatatacatatacgggaaacattctcatcgccgtcaatcctttccaaagattgccacatttgtatgatccacatatgatgcaacagtacaagggagcaccatttggagagttaagtccacatgttttcgctgtggcagatgttgcatacagagcaatgattcatgaagggaaaagcaactctattcttgtgagtggtgagagcggtgcaggtaaaacagaaacaacaaaaatgcttatgagatatcttgcctatttgggtggccgagctgctaccgagggaagaacagtagagcaacaagttctcgaatcaaatccagtccttgaagcttttggcaatgctaaaactgtcagaaacaacaattctagtcggtttggtaagtttgttgagattcagtttgataagcaagggaggatctcaggtgctgctgtgagaacttacttgctagaaaggtcacgggtgtgccaaatttctgatcctgaacgcaactaccactgcttctatctcctttgtgccgcaccacaggaggaggttgagaagtacaaattaggaaatcctaagacttttcattatcttaatcaatcaaattgctacgagttggttggggttagtgatgctcatgaatacttggctaccagaagagcaatggatattgttggcatcagtactcaggaacaggatgctattttcagggttgttgcagctatccttcatatcggtaacattgagtttgccaagggcaaagaagtcgattcctcagttttgaaagatgacaaatctaagttccaccttgacacaactgctgagcttcttatgtgtgattctggagccttgggagatgctctttgcaagcgtgtcatggtaacaccagaggaggttataaaaaggagccttgatccttacaatgcaactgtcagcagggacggtctagctaagacaatatattcccgcttgtttgactggcttgttgataaaataaacagctcaattggacaagatcctaactctaaatctcttattggtgtcttggatatctatggttttgagagcttcaagttgaacagttttgaacaattctgtattaattatacaaatgaaaaattgcaacaacatttcaatcagcacgttttcaagatggaacaggaagagtataccaaagaacaaattgattggagctatattgagtttgttgataatcaggatgttcttgaccttattgagaagaaacctggtggtgttattgcacttctagatgaggcatgtatgtttcctaagtcaacacatgagactttttcccagaagctgtaccagacatttcaaaagcacaaacggtttgtcaaaccaaagctatctcgcacagattttacaatctgtcactacgctggagaggtgttgtatcaatctgaccaattccttgataaaaacaaagactatgttgtggccgagcaccaggagttactaagcgcttccaaatgctcgtttatctctggactttttcctcctctgccagaggaaacatccaaatcctccaagttctcttcgattggagcacgcttcaagcaacaacttcaagctcttatggaaacactaaactctacagaacctcattatatcagatgtgtcaagccaaacaatgtgctaaaaccggcgatttttgagaatgtcaatgtcatgcaacagttgcgttgtggtggtgtacttgaggcaatcaggatcagctgtgcaggttatcctacacgtcgcacattttatgagtttttgcatcgctttggaatacttgctcaagaggcccttgaaggaaattgcgacgaaaaggttgcatgcaagaggattcttgaaaagaagggtcttgtgggatttcagataggcaaaacaaaagtttttctgagagctggccagatggccgaattagacgctaggagaactgaagtgctcggtgctgcggcaaaaacgattcaagggaaaatacggacacatatcatgcggaagaagttcgttaattggaggaaggcatctatatctgttcaggcaatatggagaggaagattggcttgtaaactgtttgatcaaatgcgaagggtagcagctgccatcaaagttcagaaaaaccaacgtatgcatcaggctaggaggtcctataaacacctaaatgcttcggttcttgtagtgcaaacggcattgcgagcgatggcagcaagaaatacgttcagatacaagaagcagtctaaggcagcagttaaaattcaggcccgttataggtgccatacagctcatgtgtaccataagaagttgaaacgcgcagccattgttgcgcaatgtagatggagaggaaagattgcaaggaaggaactcagaaaacttaaaatggaagctagagaaacaggtgctctcaaggaagcaaaggataaactcgaaaagaaagtggaagaacttacatggcgtgtgcagttagagaagagaatgaggacagacttggaagaagcgaaagcacaggagttgtcaaaactgcagagctctatggaagctctgcaggctaaattggacgagacaagtgcaaagcttgttaaggaaagagaagttgctagggctattgaggaggcacctcctgtagtgcaacaaactgaggttctagtccaggacactgaaaaggttgattccttgacagcagaggtggaagaactcaagacctcactacaatcagaaaaacaaagagcggatgatttggaaaaaaaacgctctgaagaacaacaagcaaatgaagaaaaacaaaagaaaatggaagagactgatgtaaaaatgcgtcaattccaggaatatcttagaaggttagaggagaagctcgctaatgtagaatctgagaataaagtccttcgtcagcaagctgtctcaatggctccaagtaaaattttgtcaggccgttccaagtccattttacagaggaatgcagaaagtgttcatgtatcaagcggcgattcgaaagcagccccagagtccaataacatatcctctcctaaaaaggaatttgacttcgatgataagccacagaagtcacttaatgaaaagcagcaggaaaatcaagatctattaattaggtgcattgctcagcatttgggctttgctggaaatcggccagtcgctgcttgcatcatatacaagtgccttcttcactggagatcatttgaagtagagaggacaagtgtttttgaccgcattattcagaccattggtcatgctattgagacacaggacaacaacgaagtcttagcatattggctctcaaatgcttcaacacttctgctgttgcttcaaaggacactgaaggcaagtggatcaacagggatggctccgcagcgacggagatcgtcatccgccactctttttggaaggatgacccagagcttcagaggaactccccaaggtgtgaatctttctctgataaatgggagcatggttagtggagtagagactctacgacaagtcgaagcaaagtatccggcgttgttgtttaagcagcaacttacggcgtatgtggaaaagatatatggaatgatccgggacaatttgaagaaagagatctctcctttgcttggtttgtgcattcaggcaccaagaacatcaagagcaagcttgatgaaaggatcttcacgttcaaacacaaatacggctgcacaacaagctttgattgctcactggcaagggattgtaaagagccttggaaatttcttgaacatgctgaaattgaacaatgttcctccatttttggtacgaaaggtattcactcagatattctcattcatcaacgtacagctttttaacagtctgctgttgagaagggagtgctgttcgttcagcaatggtgagtatgtaaaagcgggattagctgaactcgagcattggtgctatcgagctaccgatgagtatgcaggttcagcctgggacgaacttaaacatattagacaagctattggtttcctggtgattcatcaaaagccaaagaaaacgttggatgaaataagtcatgacctttgtccagtacttagtatacaacagttatacaggatcagtactatgtactgggatgataagtatggaacacacagcgtgtccccagaggttatatcaaacatgagagtattaatgactgaagactctaacaatcctgtgagcaattcatttcttctggatgacgactcgagtatacctttctccgtcgatgatatatccaaatcgatggagcagattgacatttctgacattgaaccacctccgctcattcgagagaactcaggctttgtatttctgttgccgccccctgaataa

SEQ ID NO: 220 - protein, 1529 aa, Oryza sativa
MGTKVNIIVGSHVWAEDPEIAWVDGEVVKIKGEEAEIQATNGKTITANLSKLYPKDMEAAAGGVDDMTKLSYLHEPGVLQNLATRYELNEIYTYTGNILIAVNPFQRLPHLYDPHMMQQYKGAPFGELSPHVFAVADVAYRAMIHEGKSNSILVSGESGAGKTETTKMLMRYLAYLGGRAATEGRTVEQQVLESNPVLEAFGNAKTVRNNNSSRFGKFVEIQFDKQGRISGAAVRTYLLERSRVCQISDPERNYHCFYLLCAAPQEEVEKYKLGNPKTFHYLNQSNCYELVGVSDAHEYLATRRAMDIVGISTQEQDAIFRVVAAILHIGNIEFAKGKEVDSSVLKDDKSKFHLDTTAELLMCDSGALGDALCKRVMVTPEEVIKRSLDPYNATVSRDGLAKTIYSRLFDWLVDKINSSIGQDPNSKSLIGVLDIYGFESFKLNSFEQFCINYTNEKLQQHFNQHVFKMEQEEYTKEQIDWSYIEFVDNQDVLDLIEKKPGGVIALLDEACMFPKSTHETFSQKLYQTFQKHKRFVKPKLSRTDFTICHYAGEVLYQSDQFLDKNKDYVVAEHQELLSASKCSFISGLFPPLPEETSKSSKFSSIGARFKQQLQALMETLNSTEPHYIRCVKPNNVLKPAIFENVNVMQQLRCGGVLEAIRISCAGYPTRRTFYEFLHRFGILAQEALEGNCDEKVACKRILEKKGLVGFQIGKTKVFLRAGQMAELDARRTEVLGAAAKTIQGKIRTHIMRKKFVNWRKASISVQAIWRGRLACKLFDQMRRVAAAIKVQKNQRMHQARRSYKHLNASVLVVQTALRAMAARNTFRYKKQSKAAVKIQARYRCHTAHVYHKKLKRAAIVAQCRWRGKIARKELRKLKMEARETGALKEAKDKLEKKVEELTWRVQLEKRMRTDLEEAKAQELSKLQSSMEALQAKLDETSAKLVKEREVARAIEEAPPVVQQTEVLVQDTEKVDSLTAEVEELKTSLQSEKQRADDLEKKRSEEQQANEEKQKKMEETDVKMRQFQEYLRRLEEKLANVESENKVLRQQAVSMAPSKILSGRSKSILQRNAESVHVSSGDSKAAPESNNISSPKKEFDFDDKPQKSLNEKQQENQDLLIRCIAQHLGFAGNRPVAACIIYKCLLHWRSFEVERTSVFDRIIQTIGHAIETQDNNEVLAYWLSNASTLLLLLQRTLKASGSTGMAPQRRRSSSATLFGRMTQSFRGTPQGVNLSLINGSMVSGVETLRQVEAKYPALLFKQQLTAYVEKIYGMIRDNLKKEISPLLGLCIQAPRTSRASLMKGSSRSNTNTAAQQALIAHWQGIVKSLGNFLNMLKLNNVPPFLVRKVFTQIFSFINVQLFNSLLLRRECCSFSNGEYVKAGLAELEHWCYRATDEYAGSAWDELKHIRQAIGFLVIHQKPKKTLDEISHDLCPVLSIQQLYRISTMYWDDKYGTHSVSPEVISNMRVLMTEDSNNPVSNSFLLDDDSSIPFSVDDISKSMEQIDISDIEPPPLIRENSGFVFLLPPPE

SEQ ID NO: 221 - DNA, 4041 bp, Physcomitrella patens
atggttacagagaagaagagtcaatctatactagtcagtggagagagtggagcagggaagacagagacaacaaaattgattatgcagtatttggcctacatgggtggtcgagcaaacactgatggacgaaccgtagagcaacaagtccttgagtccaatcctcttcttgaagcttttggaaatgccaagacggttcgcaatgataactcaagtcgattcggtaaattcgtggagattcaattcgacaggagcggtcggatatcaggtgctgctgtgcgtacataccttctggagagatctcgtgttgttcagattgcagaccctgaacggaattaccactgcttttaccagttgtgtgcgtcaccagaggattgtgaaagatataaactcggggacgcaagaagttttcactatttgaatcaaagtgactgtttcgagttaaacggtactaccaatggtcgggaatatgttaaaacacgcagggctatggatgttgtgggtattaaccttgaagagcaggaagccattttccgagtagtagcgtcagtgctgcatctaggaaatattgaatttgtcgcaggatcagattccgacacatcaaagctcaaagatgaccagtccaagttccatctggaggctgctgctgaacttcttcaatgtgaagcgaaaggactgttggattcattatgtacccgagttcttgttacccgtgatggcaatatcacgatgaccttgaatcaggaacaggctaccatcaaccgggatactttggcgaagacaatttactctcgcctgtttgactggttggtggacaaagtaaacagatctattggtcaagatccagattctccgtacttggttggtgtgttggatatctacggatttgaaagcttcaagttcaacagttttgagcagttctgtattaatctggccaatgagaagcttcagcagcatttcaatcagcatgtctttaaaatggagcaagaagagtatacaaaagaggccatcaactggagctacattgagtttgttgacaaccaagatgttctggatctcattgagaagaaaccttctggcattattgctcttcttgatgaagcatgcatgtttcccaagtcaacaaacgagacgttcgctacgaagttgtttcagcagtatagaaaccacaagcggttgactaagcctaagctttctcgcactgacttcacaattaatcattacgcaggagatgttacttaccagactgacttgttcctggataagaacaaagattatgttgttgccgagcatcagttactattgggatcctctagatgctcctttgtcgcaagcctttttcccagctctcccgatcaaggctccaaatcctcgtacaagttcacttccattggcactcgtttcaagcaacaattgggagcgttaatggaaactttgaatacaaccgaaccccactatatccgatgtgtgaaacctaacatggtgcacaagcctggtcgctttgagaatttgaatgtcatccagcagctgcgatgtggaggagtgttggaggccatccgaatcagctgtgcggggtacccatcgcggaggaccttttatgagtttctcgatcgttttgggatgctggcacaagaggttcttgagggaaattacgatgagaaggcggcaatagaacaacttttaaaaaaaatgagtctggagaattatcagcttggccaaacgaaggtgttcttgcgatctgggcaaatggctgaacttgatggcaaaagagctgagatgttgaataatgcagcaaaaactattcaaagacaagtgcgaacctggttagctaaaaggcaattcattgccatgcgaagagccgcagttacaatccaaagatactggcgagggtaccttgctcgtaagcaatatcagaaattgcgtcaagaagctgctgcaacaatgattcaaaagaatgttcggatgtggatcgctcgaagaaaattccttcggatcaaggaggcaattatcagggcacaatctggattccgaggaatgcaatcccgcaagaatgccagattcataagacagacgaaagctgctactcgtattcaggctcattggcgtggatacaaggctagatcagaatacaggaagtgccgaaaaagtgctattacaattcagtgtgcttggaggggcagggttgccagaaatgaactcaagaagcttaaagttgctgctaaagaaacgggtgctctgcaagaagcaaagacgaagctggagaagagatgtgaggagctcacatggcgtctacagctggagaagcgcatgcggacggatatggaggaagccaagaaccaagaaattggaaagttacaagcagcattgaaggaggagcagattcaagcacagaaagccaactcacagttgaccaaggaacttgaagataataagttggctcttggtcaagctgcacaagttataaaagaagtgccaccggtggaagtatttgacgctaaagtggagaagctaacgaaagaaaaccaagaattgcaggccctattggaagatttgaagaaaacagtatcagaatctgaagagaaattcgccaaagctaaagatgaaagtgagcagagactcaagagggcagaacaagcagaagccaaggtcactgagtcacaagaagctcttcagagcttgcaagaaaaattagcgaacatggagtctgagaatcaagttctccgtcaacaaacccttgtgctatcaccgaccaagggcttgtctaatcggttcaagagcactgtgtttcaggaaaatcaagactctttgctgcaatgtgtcatgcaagatgttggcttcaacaatgatcgacctatcgctgcttgtattttgtataagtccttgcttcagtggcgctcttttgaagctgagagaaccaatgtcttcgaccgaatcatccaaacaatcggaactgctattgaaagccaagataacaacgatgtgctggcctactggttatccaatacctctactctgctatttctgttgcaaaaaacacttaaagcaagcggagctgcagggggtgctcctcaaaggcgtcgctctaattctgtgacattgtttggtagaatgacgcaaggattccgtcagtctcctcaaccaggttccgtcacatttggaaatggaggcatcatgggcgggttagatatgtcgcggcaagtagaagccaaataccctgctctgctttttaagcagcaactcactgcatatgtggagaagatttatggcatggtccgcgacaatctgaagaaagagatttctcctttgcttggactatgcatccaagcaccaaggacctcaagggctagtctaggcaaggtttcaaggtcaccaagctcgaacgtgaatgcacagcagacactcagcagccactggcacagtattatctccagccttagttccttgctaagcactatgcgtgccaatcatgctcctcctttccttgttcgcaaactcttcacccagatcttttcgttcatcaatgttcagctgtttaacagtttgctgctgagacgtgagtgttgctcatttagcaacggagagtatgtgaaagctgggttagcagaacttgaacattggatatatgaggccggagtggagtacgctggagcatcttgggatgagctcaagtacatccgacaggcggttggatttttggtcattcatcaaaagccgaagaagtcacttgatgagatcactcatgatctctgcccggtgttaagtgttcagcagctatatcgtatcagtactatgtactgggacgacaagtatggcacccacagtgtctcgccagaggttatagcgaatatgagagttctaatgacagaggattcaaacagtgctgtcagcaactctttcttgttagatgacgattctagtatcccgttctccgtggacgatatatctaagtcaatgcctgaggttgacattgctgaggttgaaccgccaccattgttgaaggataatcctgccttccactttctattgccacaaccagattcctag

SEQ ID NO: 222 - protein, 1346 aa, Physcomitrella patens
MVTEKKSQSILVSGESGAGKTETTKLIMQYLAYMGGRANTDGRTVEQQVLESNPLLEAFGNAKTVRNDNSSRFGKFVEIQFDRSGRISGAAVRTYLLERSRVVQIADPERNYHCFYQLCASPEDCERYKLGDARSFHYLNQSDCFELNGTTNGREYVKTRRAMDVVGINLEEQEAIFRVVASVLHLGNIEFVAGSDSDTSKLKDDQSKFHLEAAAELLQCEAKGLLDSLCTRVLVTRDGNITMTLNQEQATINRDTLAKTIYSRLFDWLVDKVNRSIGQDPDSPYLVGVLDIYGFESFKFNSFEQFCINLANEKLQQHFNQHVFKMEQEEYTKEAINWSYIEFVDNQDVLDLIEKKPSGIIALLDEACMFPKSTNETFATKLFQQYRNHKRLTKPKLSRTDFTINHYAGDVTYQTDLFLDKNKDYVVAEHQLLLGSSRCSFVASLFPSSPDQGSKSSYKFTSIGTRFKQQLGALMETLNTTEPHYIRCVKPNMVHKPGRFENLNVIQQLRCGGVLEAIRISCAGYPSRRTFYEFLDRFGMLAQEVLEGNYDEKAAIEQLLKKMSLENYQLGQTKVFLRSGQMAELDGKRAEMLNNAAKTIQRQVRTWLAKRQFIAMRRAAVTIQRYWRGYLARKQYQKLRQEAAATMIQKNVRMWIARRKFLRIKEAIIRAQSGFRGMQSRKNARFIRQTKAATRIQAHWRGYKARSEYRKCRKSAITIQCAWRGRVARNELKKLKVAAKETGALQEAKTKLEKRCEELTWRLQLEKRMRTDMEEAKNQEIGKLQAALKEEQIQAQKANSQLTKELEDNKLALGQAAQVIKEVPPVEVFDAKVEKLTKENQELQALLEDLKKTVSESEEKFAKAKDESEQRLKRAEQAEAKVTESQEALQSLQEKLANMESENQVLRQQTLVLSPTKGLSNRFKSTVFQENQDSLLQCVMQDVGFNNDRPIAACILYKSLLQWRSFEAERTNVFDRIIQTIGTAIESQDNNDVLAYWLSNTSTLLFLLQKTLKASGAAGGAPQRRRSNSVTLFGRMTQGFRQSPQPGSVTFGNGGIMGGLDMSRQVEAKYPALLFKQQLTAYVEKIYGMVRDNLKKEISPLLGLCIQAPRTSRASLGKVSRSPSSNVNAQQTLSSHWHSIISSLSSLLSTMRANHAPPFLVRKLFTQIFSFINVQLFNSLLLRRECCSFSNGEYVKAGLAELEHWIYEAGVEYAGASWDELKYIRQAVGFLVIHQKPKKSLDEITHDLCPVLSVQQLYRISTMYWDDKYGTHSVSPEVIANMRVLMTEDSNSAVSNSFLLDDDSSIPFSVDDISKSMPEVDIAEVEPPPLLKDNPAFHFLLPQPDS

SEQ ID NO: 223 - DNA, 4467 bp, Populus trichocarpa
atgggaagtaaggagaatataattgtaggttctcatgtttgggttgaagaccatgagttggcttggcttgatgggaaggtatcaaagattactggacaggatgccgagatcgaagcttcaaatgggaagaaggtcacggcaaaattatcgaaaatatatccgaaagatatggaagctcctgctggtggagttgatgacatgacaaagctttcttacttgcacgagcctggagttctggagaacctgaaaacaagatatgagctgaatgaaatctatacgtatactggaaatattcttattgccatcaatccatttcaaagactgccccatctctatgatggtcacatgatgcaacaatacaagggagcaccatttggagagttaagtcctcatgtttttgcggttgctgatgtttcatacagggcaatggtcattgaagggaagagcaattccattttggtcagtggtgaaagtggtgcgggtaaaaccgagaccacgaaaatgcttatgaggtaccttgcatttttaggcggtcgagctgccactgaaggacgaacagttgaacaacaagttcttgaatcaaatccagtccttgaagcattcgggaatgctaaaactgttagaaataacaattccagccgttttggtaaatttgttgagatccagtttgacaagcacggaagaatttctggagctgccatcagaacttaccttctagagagatctcgtgtttgccaagtttccaatcctgagcgcaactaccattgtttttaccttctttgtgccgcaccacaggaggaaatagagaggtataagttggggagcccaaaatcattccactatcttaaccagtcaacttgctttgaactagttggtgtaagcgatgcgcatgactaccttgccacaagaagagctatggatattgttggaataagtgcaagggagcaggaagcaattttcagagttgttgctgcagtccttcatattggaaatattgattttgctaagggaaaggaagttgattcatcggtacctaaagatgatcaatctaaattccatctcaaaacaactgcggagctgctaatgtgtgatcctgttgccttggaagatgcattatgcaagcgtgtcatgatcactcccgaggaggttatcaagcgaagtcttgatcctcaaagtgcggtgattagcagggatggtttagctaagacgatttattctcgtttatttgattgctttgagcagttctgtattaattacacaaacgagaagttgcagcagcatttcaaccagcacgtcttcaaaatggaacaagaggaatacacaaaagagcagattgattggagctacattgagtttgtcgataatcaagatgtcttggatcttattgaaaagaaacctggtgggatagtagctctccttgatgaagcttgcatgtttcccaagtcgacacatgaaacattttcaaacaggctttatcaaacatataaagttcacaagcgctttatcaagccaaaattgtctcgcacggatttcaccattgctcattatgctggagaggtccagtatcaatccgaccactttttggacaagaacaaagactatgtagttcccgaacatcaagatttgttgggtgtttccaaatgtccttttgtagcaggtcttttccctccacttccagtagagacaagcaaatcttcaaagttctcttcgattggttctcgttttaagctacaacttcaacaactaatggaaacattaaattctactgaacctcactacataagatgtgttaagccaaacaatcagctaaaacctgccatatttgagaatatcaatatcatgcagcaattgcgttgtggtggtgttttagaagcaatccgaattagtatggctggataccctactcgtcgccctttctttgaattcgtaaatcgatttggacttcttttccccgaggctttggcaggaagctatgacgaaaaggttgcttgcaaaaagattttggaaaagaagggacttcaagggttccagataggtaaaactaaggtattcttgagagctggtcagatggctgaattggatgcaagaagagctgaggtactcaacaatgcagcaaaaaccatccaggggtgtgtacagacgcactatgctcgtaaaaggtttattgcgttgcggaaggctactgtattggtgcaatcactatggagaggaagactggcttgcaaaatttttgacagaatgaggagggaggcagctgctataaaaattcagaagcatacacgtaaatatgcagccagaacagcctacaagaaacttcatgtatctgcacttgtcgtgcaaacaggtttaagagctatgattgctcgcaaggaattcagatttaggaaacgaactaaagctgcaaccattattcaggcccggaggcgctgtcataaagctgtttcctactataagaggctaaagagaagtgcagttgtcacacaaacaggatggaggtgtagagttgctagaagagagctaaggttgctcaaaatggctgcaagagacaccggcgcactaagagaagccaaagacaagcttgaaaaacatgtagaggaactcacatggcgtttacagctcgaaaaacgattaaggaccgatttggaagaagcaagagcgcaagaggcagtgaaattccagaattcattggaagaaatgaaaattaaaatagaagaagccaatgctttgatagtcaaggagagggaggctgcaaagaatgctattaatgaggcacctcctgtaattaaagaaactcaagtactcgttgaagatactaagaaaattgattctctaacagacgaagtagaaaacctaaaggtcacgttagattatgagaaacaaagagctgatgatactcaaaagaaatacagtgaagtacaagagattagcgaagaaagacgggtgaaattggaagagacggagaaaaaggttcaacaacttcaggaatccttgcaaaggctagaagagaaacttaccaatttagagtcagagaataaagtcctacggcaacaggctctgtccatggcacccaacaagttcctctcaggacgctccagatcagtaatgcagagggttgaaagtcatattccagttgatgctgcaagaacaagtttgagcccttcaatgaaccacagggagcactctgaagtagatgataaaccacagaagtcattaaatgagaaacaacaggagaaccaggagttgctcattcgttgcgtcgcacaacacctaggctttgcagggcatagacctatagctgcttgtatcatatacaagtgccttttgcagtggagatcatttgaagttgagcgaactagtgtgtttgatcggatcatccagaccataggccatgctattgagacccaggataacaatgatagcttggcctattggttatccaatgcctcaacacttctcttactgcttcaacgtacattgaaagcaagtggtgcagcaggaatggctccacagcgtcgacgatcatcatcagctactatatttggaagaatgacacagagtttccgtggagctccacaaggagtcaatctatccttgatcaataatggtggagtggacactttgcggcaagttgaagccaagtaccccgctttgcttttcaagcagcagcttacagcatatgtagaaaaaatttatggaatgattcgggataatctgaagaaagaaatatctcctttgcttggattatgcatccaggcaccaagaacatccagagcaagcttagtgaagggggcacgctcagtagccaacactgcagcccagcaagccctgattgctcactggcaagggattgtgaagagccttggaaacttcttaagcactttgaaatctaatcatgtacccccatttttagttcgtaaggtgttcacgcagatattttccttcatcaatgttcaactattcaacagccttctattaagaagagaatgctgttcatttagcaatggtgaatatgttaaaactgggttggccgaattggagcactggtgttacaacgcaacagatgagtatgcaggttcatcctgggatgagctcaagcatattagacaggctatcgggtttctggttattcatcagaagccgaagaaaactttggatgagataagccatgacctgtgcccggttctaagtatccagcagctataccgtatcagtaccatgtactgggatgacaagtacggcacacacagtgtgtccaccgatgttatatcgaatatgagggtgctgatgacggaagattcgaataatgcagttagcagttctttcctgctggatgatgattcaagcattccattttcagttgatgacttatcaaagtccatggaacaaattgacattgctgacattgaaccaccacctctgattcgcgagaactcgggctttagtttcttgctgccgcgcatcgaataa

SEQ ID NO: 224 - protein, 1488 aa, Populus trichocarpa
MGSKENIIVGSHVWVEDHELAWLDGKVSKITGQDAEIEASNGKKVTAKLSKIYPKDMEAPAGGVDDMTKLSYLHEPGVLENLKTRYELNEIYTYTGNILIAINPFQRLPHLYDGHMMQQYKGAPFGELSPHVFAVADVSYRAMVIEGKSNSILVSGESGAGKTETTKMLMRYLAFLGGRAATEGRTVEQQVLESNPVLEAFGNAKTVRNNNSSRFGKFVEIQFDKHGRISGAAIRTYLLERSRVCQVSNPERNYHCFYLLCAAPQEEIERYKLGSPKSFHYLNQSTCFELVGVSDAHDYLATRRAMDIVGISAREQEAIFRVVAAVLHIGNIDFAKGKEVDSSVPKDDQSKFHLKTTAELLMCDPVALEDALCKRVMITPEEVIKRSLDPQSAVISRDGLAKTIYSRLFDCFEQFCINYTNEKLQQHFNQHVFKMEQEEYTKEQIDWSYIEFVDNQDVLDLIEKKPGGIVALLDEACMFPKSTHETFSNRLYQTYKVHKRFIKPKLSRTDFTIAHYAGEVQYQSDHFLDKNKDYVVPEHQDLLGVSKCPFVAGLFPPLPVETSKSSKFSSIGSRFKLQLQQLMETLNSTEPHYIRCVKPNNQLKPAIFENINIMQQLRCGGVLEAIRISMAGYPTRRPFFEFVNRFGLLFPEALAGSYDEKVACKKILEKKGLQGFQIGKTKVFLRAGQMAELDARRAEVLNNAAKTIQGCVQTHYARKRFIALRKATVLVQSLWRGRLACKIFDRMRREAAAIKIQKHTRKYAARTAYKKLHVSALVVQTGLRAMIARKEFRFRKRTKAATIIQARRRCHKAVSYYKRLKRSAVVTQTGWRCRVARRELRLLKMAARDTGALREAKDKLEKHVEELTWRLQLEKRLRTDLEEARAQEAVKFQNSLEEMKIKIEEANALIVKEREAAKNAINEAPPVIKETQVLVEDTKKIDSLTDEVENLKVTLDYEKQRADDTQKKYSEVQEISEERRVKLEETEKKVQQLQESLQRLEEKLTNLESENKVLRQQALSMAPNKFLSGRSRSVMQRVESHIPVDAARTSLSPSMNHREHSEVDDKPQKSLNEKQQENQELLIRCVAQHLGFAGHRPIAACIIYKCLLQWRSFEVERTSVFDRIIQTIGHAIETQDNNDSLAYWLSNASTLLLLLQRTLKASGAAGMAPQRRRSSSATIFGRMTQSFRGAPQGVNLSLINNGGVDTLRQVEAKYPALLFKQQLTAYVEKIYGMIRDNLKKEISPLLGLCIQAPRTSRASLVKGARSVANTAAQQALIAHWQGIVKSLGNFLSTLKSNHVPPFLVRKVFTQIFSFINVQLFNSLLLRRECCSFSNGEYVKTGLAELEHWCYNATDEYAGSSWDELKHIRQAIGFLVIHQKPKKTLDEISHDLCPVLSIQQLYRISTMYWDDKYGTHSVSTDVISNMRVLMTEDSNNAVSSSFLLDDDSSIPFSVDDLSKSMEQIDIADIEPPPLIRENSGFSFLLPRIE

SEQ ID NO: 225 - DNA, 2598 bp, Triticum aestivum
atgttcttcagcagctcagatgcggaggtgttatgcgaagcaatcaggataagctgtgctgggtatccaactacaagaacattccttgagttcattgaccgtttcggtattcttgcgcctgatgttttgactggaagttctgatgagattactgctgtaagaaagctcttagagaaggtagatctgcaaggttaccaggttggcaagacaaaagtttttcttcgttctggtcaaatggctgaacttgatgctcgtagaaatgaagtgttagggcgttcagctaacatgattcagaggaaagtccgctcgtttttggccaagaagagcttcattgcactacgaagatcagctgtacaaattcagacggtttgtcgcggagagcttgcaagaatagtttaccagggtctccgcagagaagctgcttctctcaaaatccagactagataccgtatgcataatgcgagaaaggcatacactgaactttctgcttccgcgcttaccattcaatcatcgttacgtgggatggctgcacgtaaagagatccacttcagacgtcaaactagagctgctatcattatccagactcgctgccgtcaattcttggcgaggttggattattcaagaacaagaaaagctgctattactacacagtgcatctggagaggaaaagttgctaggaaggagcttcgaaaactcaaattggctgcacgggaaactggcgctttgcaagctgccaaaaataaactggaaaagcaagtcgaagagcttacgtggcgcctacagttggagaagcgcatgcgagctgatcttgaggaatctaaatcacaagagaatgcaaagttgcaagctgccttgcaagaggtgcaacaacagtacaaggaaacaaaagacacgctagtgaaggagagagaggcggccaaaaaggtcgcagagatagagccagttattaaagaggttcccgttatagatacagagctgatgaataagcttcgagatgaaaatgataaacttaagactcttgtcagttctcttgaaaagaagattgatgatactgagaagaaatacgacgaaacaaacaaaatcagcgaggaaagactaaagaaggcaatggatgctgagtcgaaaattgatgatttaaacatggcaatgctaaggcttcaagaaaaaatatccaacatggaaactgatgagaaagtgcaaagacaagcgttgttgagcacgccagtcaggagcatgtctgagcatttgtcgattccaattgttccaaagaacctggagaatggctatcatgaggctgaagagccaaaggaaccccaaagtgcaccccctgcccttaaggattatgggaatggcgatccaaagttgagaaaatcttctgctgagaagcaacaggaaaatgtcgatgcacttattgactgtgtagcaaaaaatcttggctactgtgaggggaagccagttgctgcttttaccatatataaatgtctccttcactggaaatcttttgaggctgagaagaccagtgtttttgaccgtcttattcagttgataggatctgcaatagagaatgaggaggacaatgacaaccttgcctactggctctcaaatacgtctagcttgcttttccttttacaaagaagtctcaaagctgctggtgcacctgggactgtttcacgaaagaaacctcctcagccgacatcgttgtttggtagaatggcccaaggcttgcgctctgcatcctttgccaacatgcacgttgaagcgactgatgttgtgcgccaagttgaggccaagtatcctgcgttgcttttcaagcagcagttgactgcttacgtggagaagatttatggaatcatccgtgataatattaaaaaggaattgtcatctttgatttctttatgcatccaggctccaagaacaatgaaagctagcatgctgcgaatttctggaaggtcatctggtcaaactcagagcaaccactggcagaaaattattgagaacttggatatccttctaaaaattctacaagataaccatgtacccccagttttggctcagaaaatctttacccagatattctcatacatcaatgtacagctattcaatagtctgctccttcgccgtgagtgctgctccttcagcaatggagagtatgtcaaagctggcttagccgagttggaattgtggtgtgcaaaggcaacatccgagtatgcagcatcatcatgggatgaaatcaggcatatcagacaggctgttggctttttggttatattccagaagttcaggatatcttatgatgagatagtccatgacctatgtccgattttgagtgtccaacagctataccgaatttgtacacagtactgggacgacaagtacaatacccaaagcgtatcgtcagatgtccttagtaacatgcgggtcctaatgacggaggattcgaacaatgcagaaagcagctcatttctgttggatgataattcaagcattccattctcagtggaggatatcaccaacgcgatacaggagaaggacttctcggacgtgaaaccagccgaggagctgctcgagaaccccgcgttccagtttttacaggattag

SEQ ID NO: 226 - protein, 865 aa, Triticum aestivum
MFFSSSDAEVLCEAIRISCAGYPTTRTFLEFIDRFGILAPDVLTGSSDEITAVRKLLEKVDLQGYQVGKTKVFLRSGQMAELDARRNEVLGRSANMIQRKVRSFLAKKSFIALRRSAVQIQTVCRGELARIVYQGLRREAASLKIQTRYRMHNARKAYTELSASALTIQSSLRGMAARKEIHFRRQTRAAIIIQTRCRQFLARLDYSRTRKAAITTQCIWRGKVARKELRKLKLAARETGALQAAKNKLEKQVEELTWRLQLEKRMRADLEESKSQENAKLQAALQEVQQQYKETKDTLVKEREAAKKVAEIEPVIKEVPVIDTELMNKLRDENDKLKTLVSSLEKKIDDTEKKYDETNKISEERLKKAMDAESKIDDLNMAMLRLQEKISNMETDEKVQRQALLSTPVRSMSEHLSIPIVPKNLENGYHEAEEPKEPQSAPPALKDYGNGDPKLRKSSAEKQQENVDALIDCVAKNLGYCEGKPVAAFTIYKCLLHWKSFEAEKTSVFDRLIQLIGSAIENEEDNDNLAYWLSNTSSLLFLLQRSLKAAGAPGTVSRKKPPQPTSLFGRMAQGLRSASFANMHVEATDVVRQVEAKYPALLFKQQLTAYVEKIYGIIRDNIKKELSSLISLCIQAPRTMKASMLRISGRSSGQTQSNHWQKIIENLDILLKILQDNHVPPVLAQKIFTQIFSYINVQLFNSLLLRRECCSFSNGEYVKAGLAELELWCAKATSEYAASSWDEIRHIRQAVGFLVIFQKFRISYDEIVHDLCPILSVQQLYRICTQYWDDKYNTQSVSSDVLSNMRVLMTEDSNNAESSSFLLDDNSSIPFSVEDITNAIQEKDFSDVKPAEELLENPAFQFLQD

SEQ ID NO: 227 - DNA, 4590 bp, Zea mays
atgggaactccagttggtatcatcgttggttctcatgtttgggtggaagacccaaatctagcttggatagatggagaagttattagcataaaaaacaatgaagtacatgtgcagacatcgaatgggaaaaaggttaccacagacaggtcaaaagtatttcccaaggatatggaagctccaccaggaggagttgatgatatgacaagactttcatacttacatgaacctggtgttctacagaatcttgctacccgctatgaactgaatgaaatatatacttacacaggcagcattttgattgctgtaaatccatttcaaagattgccacatctttatgatacccacatgatggaacagtacaagggtgcagattttggggaattgagtccccatgactttgctatcgcagatgttgcttacagggcaatggataatgaagggaaaagcaactctatattggtcagtggtgaaagtggtgctgggaagactgagacaacgaagatgcttatgagatatttagcacatttaggtgggcgatctggagtagaaggacgtacagtggaacaacaagttttagagtccaacccagttcttgaagcttttggtaatgctaaaactgtgcgaaataacaactcaagtcgctttggcaagtttgttgagatccaatttgacaagactggacggatctcaggagctgctatcagaacttacttgctggaaagatcacgtgtgtgccaaattaattctccagaaagaaattaccattgcttttattttctttgtgccgcaccacctgagtacactcagaggtacaagctgtctgatcctagatctttccattacctcaatcagtcgagctgtattgaggtggatggaatcaatgatgctgaagagtatttagcaacacgaagagctatggatatagttggaatcaatgaggaagagcaggaaggtatattccgggttgtagctgctgtacttcatcttggaaatataaattttgccaagggaacagaaatcgattcttctgtaatcaaggatgataaatccaggttccaccttaatatcgcagcagaacttttgaaatgtgattgccagaatttagagaaggcgctgataacacgagttatagtcacgcctgaagaagttatcactagaacacttgatcctgcttctgcagttgctagcagagacgcattagctaaaataatatactcccgattgtttgattggattgtggaaaaaattaatgtctcaattggacaggacccaaactcaaaacaattaattggagttcttgatatctatggttttgagagcttcaaagttaacagttttgaacagctatgtatcaattatacaaatgaaaagctgcaacaacattttaaccagcacgtgttcaaaatggaacaagaagagtataccagagaagagataaactggagttacatcgagtttgttgataatcaagatgtgctagacttgatagagaagaaaggtggattgattgcacttctggatgaagcatgtatgtttcctagatctacacatgagacgtttgcgcagaagctatatacaacatttaagaataacaagcggtttgccaagccaaagctttcacgcactgattttacagtagtccattatgctggcgatgtgacataccaggctgattatttcttagacaagaacaaagattatgtagtggctgaacatcaggatctgctgaatgcttcttcatgcctattcgtagctggtttattccctcctctcccacaggagacagcaaagtcttcaaaattttcatccattggatcacgttttaagcttcaacttcaatccctcatggaaactttgagctctaccgaaccccactatattagatgtgtgaagccaaataatctccttaagccagctatttttgagaatacaaatgttatacaacaactaagatgtggaggtgttctcgaagctatcaggatcagctgtgctggatatcccacaagaaaaacattttatgaatttgtcaatcgttttggtgtccttgctcctgaagttttagaagggagcaatgatgataagattgcgtgccaaaagattttggaaaaaatgggtctggagaattaccagattggaaaaacaaaggtgtttctaagagctggacagatggctgatttggatgctcgtagagctgaagtattaggaagagcagcaagaatcatacagaggcaaatacgtacatatattgcaaggaaacagtttgctgagcttaaaagatcagcaacacagctgcaatcttttgtcagaggaaccttggctcgtaagttgtatgagtgcatgaggcaggaagcagcagcagtgaaaatacaaaagaatatgcgacgccacaaagcacgggaatcttatttacaattgcaagcagctgcaatcacattgcagacaggtttaagggcaatgtctgctcgcaaagaattcaggttcagaaaggaaacaaaagctgctgtccacatccaagctcaatggcgccgccacagagactactcacattacaagaatctgcaaggagcagctcttacttaccagtgtgcctggaggcaaaggcttgccagaagggagctcaggaagctcaagatggcggcaagagaaacaggagccctaaaagaggccaaggataaacttgagaagcgtgttgaagaactcacctggcgcttaggattggagaagcgattaaggactgaccttgaggaagcaaaagcccaggaaattgctaagctgcaagagacgttgcatgatatgcagcttcaagttgaagagtcaaaggccatggtagttaaggagagggaagctgctagaaaggcaattgaagaagcacctccagtaattaaagagactcctgtgctagtcgaagacacagaaaagattaactcactgacgaccgaagttgaacaactgaaggctttgctgctaactgaaagacaagcaacagaagctgcaaaaagagaacacgctgaatctgaactgagaaatgaagaactaattaagaaatttgagagcgcagagaaaaagattgagcaacttcaggaaactgtccataggctggaggagaaagcaaccaacatggagtctgagaacaaagtgctccgtcaacaagctgttgcaatttctcctacgtcaaaatcattagctgcatatcctaagtctcctttccagctgaaaactccggagaatgggaatgctctaaatggagaagtgaagtcatcaccagatatcacccctatcttaccaaaccccaaggagcttgaggctgaagagaagccacaaaaatcacttaatgaaaagcagcaggaaaatcaagacctactgatcaagtgtgtatcacaagatctgggattctccagtggcaaacctattgcagcttgccttatctacaggtgtcttctacactggagatcattcgaagttgaaagaactggtgtttttgaccgtattattcaaacaattggctctgctattgagtcccaggacaacaatgacaagttggcatattggctctcgaattcatccacactgctgctgctgctgcaacgaacactgaaaacaactggagcagctggattcactcctcaaaggcgcaggtcatctgctgcatcttttgggagggtgttttcggggatgcgagcctcaccacaaagtgctgggcgtgcttttatgggaagtcgcttgattggaggtctaggtgaccttcgtcaagttgaagccaagtaccctgccctgcttttcaagcaacagctcacagctttccttgagaagatctatggaatgataagagacaatttgaaaaaggagatatctcctttgcttggcctttgcatccaggcaccaagaacatcccgtgcaagcctaattaaagggtcacgttcccaagcaaatgccttagctcagcaaactctgattgcacattggcagagcattgtgaaaatattgacaaattacttgaatgttttaaaagcaaattatgtcccttcagtcttaatcagcaaagtgttcactcaaatcttttcatttattaatgttcagttatttaatagtcttcttcttcgacgggagtgctgttcatttagcaacggagaatatgtgaaagctggattggcagaattagagcagtggtgcatttatgcaacagaagagtatgcaggttcttcctgggaagaattaaaacatattaggcaggctgttggattccttgtgattcatcaaaagccaaagaaaacattgaaagaaatcaccaacgatctgtgccctgtccttagcatacaacagctatatcgaatcagtacaatgtactgggatgataagtacggtacccacactgtttcatcagatgtcatctcaagtatgagagtaatgatgacagaagattctaataacgcggtcagcagttcgttcctgttggatgatgattccagcattccgttttcggtggacgacatctcgaagtcgatgacagaaatcgaggtaacagatgtcgacatgccacctctgatacgggagaattctgggttcaccttcctacaccagagaaaggactaa

SEQ ID NO: 228 - protein, 1529 aa, Zea mays
MGTPVGIIVGSHVWVEDPNLAWIDGEVISIKNNEVHVQTSNGKKVTTDRSKVFPKDMEAPPGGVDDMTRLSYLHEPGVLQNLATRYELNEIYTYTGSILIAVNPFQRLPHLYDTHMMEQYKGADFGELSPHDFAIADVAYRAMDNEGKSNSILVSGESGAGKTETTKMLMRYLAHLGGRSGVEGRTVEQQVLESNPVLEAFGNAKTVRNNNSSRFGKFVEIQFDKTGRISGAAIRTYLLERSRVCQINSPERNYHCFYFLCAAPPEYTQRYKLSDPRSFHYLNQSSCIEVDGINDAEEYLATRRAMDIVGINEEEQEGIFRVVAAVLHLGNINFAKGTEIDSSVIKDDKSRFHLNIAAELLKCDCQNLEKALITRVIVTPEEVITRTLDPASAVASRDALAKIIYSRLFDWIVEKINVSIGQDPNSKQLIGVLDIYGFESFKVNSFEQLCINYTNEKLQQHFNQHVFKMEQEEYTREEINWSYIEFVDNQDVLDLIEKKGGLIALLDEACMFPRSTHETFAQKLYTTFKNNKRFAKPKLSRTDFTVVHYAGDVTYQADYFLDKNKDYVVAEHQDLLNASSCLFVAGLFPPLPQETAKSSKFSSIGSRFKLQLQSLMETLSSTEPHYIRCVKPNNLLKPAIFENTNVIQQLRCGGVLEAIRISCAGYPTRKTFYEFVNRFGVLAPEVLEGSNDDKIACQKILEKMGLENYQIGKTKVFLRAGQMADLDARRAEVLGRAARIIQRQIRTYIARKQFAELKRSATQLQSFVRGTLARKLYECMRQEAAAVKIQKNMRRHKARESYLQLQAAAITLQTGLRAMSARKEFRFRKETKAAVHIQAQWRRHRDYSHYKNLQGAALTYQCAWRQRLARRELRKLKMAARETGALKEAKDKLEKRVEELTWRLGLEKRLRTDLEEAKAQEIAKLQETLHDMQLQVEESKAMVVKEREAARKAIEEAPPVIKETPVLVEDTEKINSLTTEVEQLKALLLTERQATEAAKREHAESELRNEELIKKFESAEKKIEQLQETVHRLEEKATNMESENKVLRQQAVAISPTSKSLAAYPKSPFQLKTPENGNALNGEVKSSPDITPILPNPKELEAEEKPQKSLNEKQQENQDLLIKCVSQDLGFSSGKPIAACLIYRCLLHWRSFEVERTGVFDRIIQTIGSAIESQDNNDKLAYWLSNSSTLLLLLQRTLKTTGAAGFTPQRRRSSAASFGRVFSGMRASPQSAGRAFMGSRLIGGLGDLRQVEAKYPALLFKQQLTAFLEKIYGMIRDNLKKEISPLLGLCIQAPRTSRASLIKGSRSQANALAQQTLIAHWQSIVKILTNYLNVLKANYVPSVLISKVFTQIFSFINVQLFNSLLLRRECCSFSNGEYVKAGLAELEQWCIYATEEYAGSSWEELKHIRQAVGFLVIHQKPKKTLKEITNDLCPVLSIQQLYRISTMYWDDKYGTHTVSSDVISSMRVMMTEDSNNAVSSSFLLDDDSSIPFSVDDISKSMTEIEVTDVDMPPLIRENSGFTFLHQRKD

SEQ ID NO: 229 - DNA, 1629 bp, Brassica napus
atgtcgctgaggccgagcacacgcgcggagctgaggaagaagatatacaagacaggtgtcgatgccgatgaggcgaggcggaggagagaagacaacctcgtcgagattcgaaaaaacaagcgcgaggacagtctcctcaagaaacgccgcgaaggcatgatgctccagcagcagcagcagcctctcggagcagctggtctcgatgccctccagagcgctgccgccgttgagaaacgattggaaggtataccaatgatggtacaaggtgtttattctgaggatcctcaagctcagctagaagctactactcagtttagaaagttgttatctattgagcgcagtcctccaattgatgaggtgatcaaagctggtgttatccctcgttttgttgagtttcttcgaaggcaagaccatccacaactccagtttgaggctgcatgggctttgaccaacgttgcgtcaggaacatcagatcatactcgggttgtgattgaacatggggcggtacctatcttcgttgagcttcttagctctgctagtgatgacgttcgagagcaggccgtgtgggccttggggaatgttgctggagactcgccaaactgcaggaaccttgttctcagctgtggtgctcttgcacccttgctgtctcagttaaacgaaaattcaaagttatccatgctaaggaatgctacatggaccttgtccaacttttgtcgtgggaaaccaccaacaccatttgaagaggtgaagcctgccttgccagttctccggcagcttatttatctgaatgatgaagaagttctcactgatgcatgctgggctctctcctacctttcagatggccccaatgataagattcaggctgtgatccaggcaggtgtctgtccacgacttgtggagcttctgagtcatccatcacctacggttctcattcctgccctccgaaccgttgggaacattgtaaccggtgatgactctcagacacagtttataattgatagtggagtacttccacacctttataatttgcttacgcaaaatcacaagaaaagtatcaaaaaagaagcttgttggacaatctcgaatatcactgctgggaataaagttcagatagaggctgtagttggcgctggtattgtcctccctcttgtgcatttgctccaaaacgcggagttcgatataaagaaggaagctgcgtgggctatttcaaatgctacctcaggagggtctcatgagcagattcagtatttggtagcacaaggctgcatcaagcctctttgtgatcttctaatttgccctgatccgaggatcgtgacagtgtgcttagaggggcttgagaacattctcaagattggtgaggctgacaaggagatggggttaaacggtggagtaaatctctatgctcagatagttgaagaatctgatgggttggacaaaattgaaaaccttcagtcccatgataacaatgagatatatgagaaggctgttaagatcttggagagatattgggctgaggaagaagaggatgagcagattctgccagacggtgtgaatgaaaatccacaacagggcttcagttttgggaataaccagaccgctgctccccctggtggatttaaatttggttga

SEQ ID NO: 230 - protein, 542 aa, Brassica napus
MSLRPSTRAELRKKIYKTGVDADEARRRREDNLVEIRKNKREDSLLKKRREGMMLQQQQQPLGAAGLDALQSAAAVEKRLEGIPMMVQGVYSEDPQAQLEATTQFRKLLSIERSPPIDEVIKAGVIPRFVEFLRRQDHPQLQFEAAWALTNVASGTSDHTRVVIEHGAVPIFVELLSSASDDVREQAVWALGNVAGDSPNCRNLVLSCGALAPLLSQLNENSKLSMLRNATWTLSNFCRGKPPTPFEEVKPALPVLRQLIYLNDEEVLTDACWALSYLSDGPNDKIQAVIQAGVCPRLVELLSHPSPTVLIPALRTVGNIVTGDDSQTQFIIDSGVLPHLYNLLTQNHKKSIKKEACWTISNITAGNKVQIEAVVGAGIVLPLVHLLQNAEFDIKKEAAWAISNATSGGSHEQIQYLVAQGCIKPLCDLLICPDPRIVTVCLEGLENILKIGEADKEMGLNGGVNLYAQIVEESDGLDKIENLQSHDNNEIYEKAVKILERYWAEEEEDEQILPDGVNENPQQGFSFGNNQTAAPPGGFKFG

SEQ ID NO: 231 - DNA, 1596 bp, Glycine max
atgtcgctgaggccgaatgctagaaccgaggttcgccgcaaccgctacaaggtggcggtggacgccgacgagggtcgccggaggagggaggacaacatggtggagatccgcaagagcaagcgcgaagagagcctccagaagaagcgccgcgaaggcctccaagctcagcagcagttccccactcctctccaagccgcctccattgtcgagaaaaagttagagagtcttcctgcgatggttgctggagtgtggtccgatgataacagccagcaactggaagcgaccacgcagtttcggaaactgctttcgattgagcgcagtcctccaattgaggaagttattcaagctggggttgtgcctcgatttgtggagtttcttgttagggaggatttccctcaacttcagtttgaggctgcgtgggctctcacaaacatagcatctggaacttctgagaataccaaggtggtgattgatcatggggcagttccgatatttgtcaagctacttagttcgcccagtgatgatgttcgggagcaggcagtgtgggcattggggaatgttgctggtgactctcctaagtgtcgtgatcttgttctcagccatggtgccctgatcccactgttggcccagttgaatgaacatgcaaaactttcaatgttgagaaacgcgacatggaccctgtcaaacttctgcaggggcaagccacagcctccatttgagcaggtgagggcagcgcttcctgctctagaacgattggttttttccaatgatgaagaagtcttgacagacgcatgttgggcactatcatatctttccgatggaacaaatgacaaaatccaagccgttattgaggctggtgtgtgtcccagactggtgcagctccttctgcacccatccccttcagtgctgattcctgctcttcgcacagtgggaaatattgtgacaggagatgatatgcagactcagactatcatcaatcatggtgcgctcccatgcctcttgagcctgttgacacataatcataaaaaaagtatcaagaaagaagcttgctggaccatttcaaacattacagctggaaacagagatcagatacaggctgttgttgaagctggtttgattgccccccttgtcaatcttcttcaaaatgctgagtttgacattaaaaaagaagctgcttgggcaatctcaaatgctacatctggtggtacccatgagcagatcaagtatctggtgagccagggttgcattaagcctctctgtgatctgcttgtttgcccggacccaagaatcgtcactgtctgtttagaaggacttgagaatattctgaaggttggggaagctgagaagagcatgggtaacagtggagatgtcaacttgtatgcacagatgatagacgaagcagagggattggagaaaattgaaaacctgcagagtcatgacaacaatgaaatatatgaaaaggctgttaaaattcttgagacatattggttggaagacgatgatgagacactacctacaggcgatggtgctcaacctggttttaattttggaaacaatgatgttccagttccatctggtggattcaactttagttga

SEQ ID NO: 232 - protein, 531 aa, Glycine max
MSLRPNARTEVRRNRYKVAVDADEGRRRREDNMVEIRKSKREESLQKKRREGLQAQQQFPTPLQAASIVEKKLESLPAMVAGVWSDDNSQQLEATTQFRKLLSIERSPPIEEVIQAGVVPRFVEFLVREDFPQLQFEAAWALTNIASGTSENTKVVIDHGAVPIFVKLLSSPSDDVREQAVWALGNVAGDSPKCRDLVLSHGALIPLLAQLNEHAKLSMLRNATWTLSNFCRGKPQPPFEQVRAALPALERLVFSNDEEVLTDACWALSYLSDGTNDKIQAVIEAGVCPRLVQLLLHPSPSVLIPALRTVGNIVTGDDMQTQTIINHGALPCLLSLLTHNHKKSIKKEACWTISNITAGNRDQIQAVVEAGLIAPLVNLLQNAEFDIKKEAAWAISNATSGGTHEQIKYLVSQGCIKPLCDLLVCPDPRIVTVCLEGLENILKVGEAEKSMGNSGDVNLYAQMIDEAEGLEKIENLQSHDNNEIYEKAVKILETYWLEDDDETLPTGDGAQPGFNFGNNDVPVPSGGFNFS

SEQ ID NO: 233 - DNA, 888 bp, Gossypium hirsutum
atggactcccttaacttttgtcggggaaagccccagcctccctttgatccggttaaacctgcacttcctgcattgacacaccttattcattcgaatgatgaagaagtcttaactgatgcatgttgggcgctctcatatctttctgatggtacaaatgacaaaatccaagctgttatagaagcaggtgtttgtgggcgtctggtggagctcttgatgcacccatctccttcagtgctaatacctgctcttcgcacagttggaaatattgtcacaggagatgatggtcaaacccagtgtattatcaatcatcaagtgttgccatgccttctaaacctcttgacaaataatttcaaaaagagcatcaagaaggaagcttgttggacaatctcaaatatcacagctggaaataaggagcagatacaggctgtaattgaagctaatattatatctccactggttcatctgcttcaaaatgctgaatttgatatcaagaaagaagcggcatgggccatctcaaatgccacatctggtggtactcatgatcagatcaaattccttgttagtcaaggttgtataaagccattgtgtgatcttcttaactgccctgatccaaggattgtaacagtctgtttagaagggcttgaaaacattttgaaggtaggagaagctgataagaacctgggcactaccggaggagtgaatctctatgcacaaatgattgatgatgctgagggtctggagaagatcgagaatttacagtcccacgataacactgagatttatgaaaaggctgtgaaagtctcgagacatattggtttggaggaggagaatgaaacaatgccgcgggtgatgcctcctcaacaggggtttcctttttggcgggggtga

SEQ ID NO: 234 - protein, 295 aa, Gossypium hirsutum
MDSLNFCRGKPQPPFDPVKPALPALTHLIHSNDEEVLTDACWALSYLSDGTNDKIQAVIEAGVCGRLVELLMHPSPSVLIPALRTVGNIVTGDDGQTQCIINHQVLPCLLNLLTNNFKKSIKKEACWTISNITAGNKEQIQAVIEANIISPLVHLLQNAEFDIKKEAAWAISNATSGGTHDQIKFLVSQGCIKPLCDLLNCPDPRIVTVCLEGLENILKVGEADKNLGTTGGVNLYAQMIDDAEGLEKIENLQSHDNTEIYEKAVKVSRHIGLEEENETMPRVMPPQQGFPFWRG

SEQ ID NO: 235 - DNA, 1575 bp, Hordeum vulgare
atgtcggtgcgcccgagcgagagggccgacgcgcggcggaaccgctacaaggtgacggtggacgccgatgaggggcggcggcggcgcgaggacaacatggtggagatccgcaagaaccgccgcgaggagagcctcctcaagaagcgccgcgaggggctccaggcccaggctcccatacccgccgccggcgtcgagaagaagcttgaaagcttacctgctatggttggtggggtttattcggaggataacaacctgcagcttgaggcaacgacacaattccgcaagttgctttctatagaaaggagccccccaatcgaagaagttatccaatcaggcgttgttcctcgatttgtgcagtttcttactagggaggatttcccccaactccagtttgaagcagcgtgggcactcacaaacattgcgtctggcacatcagagaataccaaggttgtcattgatcatggggcagttccaatatttgtgaagcttcttgcgtctggcagtgatgatgttcgtgagcaggcggtctgggcactgggcaatgttgctggtgactccccaaagtgccgtgaccttgttctcgcaaatggcgcattgatgcctctgctagcacagttgaatgagcatgctaaactctccatgttaaggaatgcgacctggactttatcaaatttctgcagaggaaagccacaaccagcatttgatcagactaagcctgctctgccagcacttgcacgacttatccattccaatgatgaggaagttttaactgatgcatgctgggctctttcctatctctctgatggcaccaatgacaagatccaatctgtgattgatgctggtgtctgtccccgacttgtggagcttctcctccatccatcaccttcagtgcttatacctgcactacgaactgttggaaatattgtcacaggagatgactcacaaactcagtgcatcattgatcatcaagctcttgggtgtctcctcagtctgttgacagaaaatcacaagaaaagcattaagaaagaggcctgctggactgtttcaaatatcactgctggtaacaaagatcagatacaggctgtgattactgctggaattatttttcctttggtgcatctgctgcaaacggctgagtttgatatcaagaaggaggctgcttgggccatctcgaatgctacctccggtggttcccatgaccaaataaagtatttggttagcgagggctgcatcaagccactgtgtgacctcctcctttgcccagatccaagaatcgttacagtttgcttggagggtcttgagaacattctcaaagttggagaaactgataagaatttgggtgcttctggggagggaaatgtctatgcacagatgattgatgaagcagaaggcctggaaaagattgagaacctgcagagccatgataacaatgaaatctatgagaaggctgtgaagattcttgaggcttactggatggaggaggaagatgatgcgatggggacaactatggaagctcccacaggtgttgcctttgactttggccaaggtggcaaccctgatctgaacttgggctga

SEQ ID NO: 236 - protein, 524 aa, Hordeum vulgare
MSVRPSERADARRNRYKVTVDADEGRRRREDNMVEIRKNRREESLLKKRREGLQAQAPIPAAGVEKKLESLPAMVGGVYSEDNNLQLEATTQFRKLLSIERSPPIEEVIQSGVVPRFVQFLTREDFPQLQFEAAWALTNIASGTSENTKVVIDHGAVPIFVKLLASGSDDVREQAVWALGNVAGDSPKCRDLVLANGALMPLLAQLNEHAKLSMLRNATWTLSNFCRGKPQPAFDQTKPALPALARLIHSNDEEVLTDACWALSYLSDGTNDKIQSVIDAGVCPRLVELLLHPSPSVLIPALRTVGNIVTGDDSQTQCIIDHQALGCLLSLLTENHKKSIKKEACWTVSNITAGNKDQIQAVITAGIIFPLVHLLQTAEFDIKKEAAWAISNATSGGSHDQIKYLVSEGCIKPLCDLLLCPDPRIVTVCLEGLENILKVGETDKNLGASGEGNVYAQMIDEAEGLEKIENLQSHDNNEIYEKAVKILEAYWMEEEDDAMGTTMEAPTGVAFDFGQGGNPDLNLG

SEQ ID NO: 237 - DNA, 1686 bp, Medicago truncatula
atgtcgctcagacccaatgcaagaacagaggttcgtcgcaaccgttacaaagttgccgtcgatgccgatgaaggtcgccggagaagagaggataacatggtcgagatccgtaaaagtaagcgtgaagaaagtctcttgaagaaacgtcgtgaaggtcttcaaaatcaaccgcagtttactcctcttcaatcttcctccattgtcgagaaaaagttggagagtcttcctgcaatggttgctggtgtttggtcagatgataataatcaacaacttgaagcaactacgcaatttcggaagcttctttccatagagcgaagccctccgattgaggaagttattcaatctggtgttgttccccgctttgttcagtttctagttcgggaggattttccccaacttcagtttgaggctgcttgggctcttacaaacatagcatccggaacttctgagaatactaaggtggtaattgatcatggggcagtgccgatatttgtgaagctacttagttctccaagtgatgatgttcgggagcaggctgtgtgggcattgggaaatgttgctggtgattcacctaggtgccgcgatcttgttcttagccatggtgccctgatcccgctgttaacccagttgaatgagcaggcaaagctttcaatgctgagaaatgccacatggactctgtcaaacttttgcaggggcaagccacaacctccatttgatcaggtgaggccagcacttccggctcttgagcgtttggttttttcaaatgatgaagaagtcctgacagatgcatgctgggcactctcttatctttctgatggaacaaatgacaaaatccaagcggtgattgaggcaggtgtatgtggcagactagtgcagctccttctgcacccatctccttcagtgctgatccctgcacttcgcacggtgggaaatattgttacgggagatgatgcacagactcaggctattattggtcatggttcactcccatgtcttttgagcctgttgacccataatcacaagaaaagtattaagaaagaagcttgctggactatatcaaacattacagctggaaacaaagagcagatacaggctgttattgaagccggactgattgctcctctggtcaatcttcttcaaaatgccgaatttgacattaaaaaagaagctgcatgggcactctccaatgctacatctggcggtacccatgagcaaatcaagtacttggtgagccagggttgcattaagcctctgtgtgatcttcttgtttgccccgatccaagaattgttaccgtctgtttagaaggtcttgagaatattctgaagattggagaagcagagaaaagctttggtaacgcgggagatgtcaacttgtatgctcagatgatagatgaggcggagggattggaaaagattgagaacctgcagagtcatgacaacaatgaaatttacgagaaggctgttaaaattctcgagacatattggttggaagatgaagacgagacactaccaccaggcgatggttctcaacctggttttaattttggaggcaatgaccttccggtcccatctggaaggaactgtgttggatgcagcagggtactgttggcgttgagtccgggtggggtgggggagggggggcgtcggtctttgtacttcatggtgtctggtgtcagtctggtctag

SEQ ID NO: 238 - protein, 561 aa, Medicago truncatula
MSLRPNARTEVRRNRYKVAVDADEGRRRREDNMVEIRKSKREESLLKKRREGLQNQPQFTPLQSSSIVEKKLESLPAMVAGVWSDDNNQQLEATTQFRKLLSIERSPPIEEVIQSGVVPRFVQFLVREDFPQLQFEAAWALTNIASGTSENTKVVIDHGAVPIFVKLLSSPSDDVREQAVWALGNVAGDSPRCRDLVLSHGALIPLLTQLNEQAKLSMLRNATWTLSNFCRGKPQPPFDQVRPALPALERLVFSNDEEVLTDACWALSYLSDGTNDKIQAVIEAGVCGRLVQLLLHPSPSVLIPALRTVGNIVTGDDAQTQAIIGHGSLPCLLSLLTHNHKKSIKKEACWTISNITAGNKEQIQAVIEAGLIAPLVNLLQNAEFDIKKEAAWALSNATSGGTHEQIKYLVSQGCIKPLCDLLVCPDPRIVTVCLEGLENILKIGEAEKSFGNAGDVNLYAQMIDEAEGLEKIENLQSHDNNEIYEKAVKILETYWLEDEDETLPPGDGSQPGFNFGGNDLPVPSGRNCVGCSRVLLALSPGGVGEGGRRSLYFMVSGVSLV

SEQ ID NO: 239 - DNA, 1605 bp, Oryza sativa
atgtcgctgcggccgagcgagcgggcggaggtgcggcggagcaggtacaaggtggcggtggacgcggacgaggggcggaggcggagggaggacaacatggtggagatccgcaagagccggcgcgaggagagcctcctgaagaagcgccgcgacggcctccccgccgccgccgcggccgccgcggcggcgtccccgctgctcgcccactcctccgcgctccagcagaagttggaggggttgccggcgatggtgcaggcggtgcagtccgacgacagcgccgtgcagctggaggccaccacgcagttccggaagctgctctccatcgagcggagtcctccaattgaggaggtgatcaacacaggggtggtgcctcgctttattgccttcctccaacgtgaggattatccccaactccagtttgaggctgcatgggcactcactaacattgcatcaggcacatcagataacaccaaagtggtagttgagtctggtgctgtgcccatctttgtcaaactgcttagctcccccagtgaggatgtccgtgagcaggctgtatgggctctgggaaatgtggctggtgactcaccaaaatgccgtgacctggtgcttgcaagtggtgggttatacccattgttgcaacagcttaatgagcacgccaagctctcaatgctcaggaatgccacatggacactgtcaaacttctgccgtgggaagcctcagcctaattttgagcaggtcaaaccagcgctttctgcactgcagcgcctcatccattctcaggacgaggaggtcctgactgatgcctgctgggctctttcttatttgtctgatggaactaatgataagatccaagctgtgatagaatcaggagtgttcccaaggcttgtggaacttctcatgcatccttcggcttcagtgctcattccagctttgcgcacggtgggtaacatcgtcactggggatgacatgcagactcagtgtgtcatcgatcatcaagctcttccatgtctcttgaacctcttgaccaacaatcataagaaaagcatcaagaaagaagcatgctggactatctcaaacatcactgctggcaatagggaacagattcaggctgtgatcaatgcaaacataattgctcctctagtacatctgctgcaaactgctgaatttgacatcaagaaagaggctgcgtgggcaatctcaaatgccacttctggtggaacacatgatcagattaagtaccttgttgcccagggttgcatcaagccactctgtgatctgcttgtttgcccagatcccaggatcgtgacagtttgcttggaaggtcttgagaacatcttgaaggttggagaggcagaaaagaaccttggggcaggggatgtcaattcctatgctcagatgattgatgatgctgagggactggagaagattgagaaccttcagagccatgacaacactgaaatatatgagaaggcagttaaaatgctcgagtcctactggttggaggaggaagatgatgccatgccctcaggtgacaacgctcaaaacggcttcaactttggaaaccagcagcccaatgttccatcgggtggattcaactttggctga

SEQ ID NO: 240 - protein, 534 aa, Oryza sativa
MSLRPSERAEVRRSRYKVAVDADEGRRRREDNMVEIRKSRREESLLKKRRDGLPAAAAAAAAASPLLAHSSALQQKLEGLPAMVQAVQSDDSAVQLEATTQFRKLLSIERSPPIEEVINTGVVPRFIAFLQREDYPQLQFEAAWALTNIASGTSDNTKVVVESGAVPIFVKLLSSPSEDVREQAVWALGNVAGDSPKCRDLVLASGGLYPLLQQLNEHAKLSMLRNATWTLSNFCRGKPQPNFEQVKPALSALQRLIHSQDEEVLTDACWALSYLSDGTNDKIQAVIESGVFPRLVELLMHPSASVLIPALRTVGNIVTGDDMQTQCVIDHQALPCLLNLLTNNHKKSIKKEACWTISNITAGNREQIQAVINANIIAPLVHLLQTAEFDIKKEAAWAISNATSGGTHDQIKYLVAQGCIKPLCDLLVCPDPRIVTVCLEGLENILKVGEAEKNLGAGDVNSYAQMIDDAEGLEKIENLQSHDNTEIYEKAVKMLESYWLEEEDDAMPSGDNAQNGFNFGNQQPNVPSGGFNFG

SEQ ID NO: 241 - DNA, 1605 bp, Physcomitrella patens
atgtctctccgtcccaacgcccgtgttgaggtccgcaagaagggtttcaagctggcaatcgatgccgatgaagcacgtagaaagagagaggacaacatggtggagattcggaagagcaagagagaggagagtcttctgaagaagcgtagagatggtatggttaaactgcagcagcagttcatgcccgccgcgcagactggcgctgccgagaagaagcaactggaaagcctccctgccatggttgctggagtttactctgacgaccccgcaacgcagttggaatcaaccacccaattcagaaagcttctctctattgagcgcagtccaccaatcgaagaggttatcgcagcaggtgttgtacctcggtttgtcgagtttctagtcaggaatgacttcccacagttgcagttcgaagctgcctgggcgttgacaaatattgcttccggaacttctgatcacacccgggtggttattgatcacggagctgtgccaattttcgttcagctcctgagttctccgagcgatgacgttcgagagcaggctgtatgggcattagggaatgtagcgggtgactctccaaagtgcagagatcttgttcttaaccatggcgctttgatgcctctgcttgctcagcttactgacaacacgaagttgtcaatgctgcggaatgcaacgtggaccctatccaacttttgtcgtggcaagcctcagccacctttcgagcagtccaagcctgcactcccagctttggagcgactcattcattcaaatgatgaagaagtccttacagatgcatgctgggccctatcttatttgtccgatggaacaaacgacaagatacaggctgtgattgaagctggtgtttgccgacgtctcgtggagctactgctcagccatccatcaccgtccgtgctaattcctgcactgcgcaccgtgggcaacatcgttactggtgacgaccttcagacccagttcatcatcaacaaccaggcccttccttgtctcctggctctcctgaccaacaatcacaagaaaagcattaagaaagaagcttgttggactatttcgaacataaccgcaggaaacaaggatcagattcaggccgtgattgacgcgaacattattccaccgcttgtatctttgctcgccactgctgagtttgacattaagaaagaagcagcttgggctatttcgaatgccacatccggtggaacgcacgatcaaatcaaatacctcgtcaaccagggttgtattaaaccactttgcgacttattgacctgcccagatccgagaattgtaaccgtctcccttgaaggtctggagaatatcttgaaggtcggagagcaggagaaagatcttggaaaaactggtgggatcaacgaatatgctcgctatattgatgaagccgagggcttagagaagattgagaacctccaaactcacgataacaatgaaatttacgagaaggctgtaaagatcttggagacgtactggttagaagaggatgaggagcagaatactgcacctggtacagatggtcaaagcttcgcgttcggttcaagtaatgtcgcaggagctcctcctggcgggttcaactttggctga

SEQ ID NO: 242 - protein, 534 aa, Physcomitrella patens
MSLRPNARVEVRKKGFKLAIDADEARRKREDNMVEIRKSKREESLLKKRRDGMVKLQQQFMPAAQTGAAEKKQLESLPAMVAGVYSDDPATQLESTTQFRKLLSIERSPPIEEVIAAGVVPRFVEFLVRNDFPQLQFEAAWALTNIASGTSDHTRVVIDHGAVPIFVQLLSSPSDDVREQAVWALGNVAGDSPKCRDLVLNHGALMPLLAQLTDNTKLSMLRNATWTLSNFCRGKPQPPFEQSKPALPALERLIHSNDEEVLTDACWALSYLSDGTNDKIQAVIEAGVCRRLVELLLSHPSPSVLIPALRTVGNIVTGDDLQTQFIINNQALPCLLALLTNNHKKSIKKEACWTISNITAGNKDQIQAVIDANIIPPLVSLLATAEFDIKKEAAWAISNATSGGTHDQIKYLVNQGCIKPLCDLLTCPDPRIVTVSLEGLENILKVGEQEKDLGKTGGINEYARYIDEAEGLEKIENLQTHDNNEIYEKAVKILETYWLEEDEEQNTAPGTDGQSFAFGSSNVAGAPPGGFNFG

SEQ ID NO: 243 - DNA, 1614 bp, Populus trichocarpa
atgtcgctgcgaccaggtacacgaacagaggtgaggaagaagtcgtacaagactggagtggatgcagatgaagcaagaaggaggagagaggacaatttactggagatcagaaagaataaaagagaagacaatcttttgaagaaaagaagagaaggtcttttgtttcagtctcaaagtcagcctttgcttgatgctgctcaacatgctgccaatatcgaaaaaaagttggagagtcttccgatgatggtccaaggagtgtggtctgatgatccttccttacagttggaagcaaccactcagtttagaaagcttttatctattgagcgcagtcctcctatagatgatgtaatcaaagcaggtgtggtcccgcggtttgtggaattccttggaaggcacgatctgcctcaactacaatttgaggctgcgtgggctttgactaatgttgcttctggaacatcagagcatacacgagttgtcattgaccatggtgctgttcctatgtttgtgcagcttcttagttctggaagtgatgatgtcagagagcaggcggtatgggccttgggcaatgttgcgggcgactccccaagttgcagggatcttgttcttggtcatggtgctctgatgccattgctagctcagctaaatgagaattcaaaattatccatgcttaggaatgctacctggacattatccaatttttgtcgtggcaagccaccaacaccatttgatcaggtgaagcctgctttgccagttctccagcaacttatccacttgaatgatgaagaagtcttaacagatgcatgctgggcactctcctatctttcagatggtcaaaacgacaaaattcaggctgtgattgatgctggtgtctgtcgacgtctggtggagcttcttcttcatccatcacctacagttcttattcctgcccttcgaacagttggaaacattgttacaggcgatgacggtcagactcagtttgtaattgacaatcaagtcctcccttgtctccaccaacttctcttgcaaaatcacaaaaaaagtatcaagaaagaagcgtgttggacaatctctaatatcacagctggaaatagaactcaaatacaggctgttattgaggccaatattattctccctcttgtaaaccttctgcaacatgcggagtttgacattaagaaggaggctgcctgggctatctcaaacgccacctctgcaggctctcatgaacaaattcaatttctggtgagccagggttgcattaaaccactgtgtgatcttcttatctgcccagaccccaggatcgtgacggtctgccttgaggggctggagaacatccttaaggtgggtgaggctgacaaggaaatgggcttaaatggtggagttaatctgtatgcgcaaatggttgatgaatgtgatggattggataagattgagaatctgcaaactcatgacaacaacgagatttatgaaaaggcagtgaagattttggagagatactgggctgaggaagaagatggagaaccgattgtccaagatggtggggatggaaatcagcaaggttttgcttttggaactaaccagcctagtgttccccaaggtggcttcaagtttgggtga

SEQ ID NO: 244 - protein, 537 aa, Populus trichocarpa
MSLRPGTRTEVRKKSYKTGVDADEARRRREDNLLEIRKNKREDNLLKKRREGLLFQSQSQPLLDAAQHAANIEKKLESLPMMVQGVWSDDPSLQLEATTQFRKLLSIERSPPIDDVIKAGVVPRFVEFLGRHDLPQLQFEAAWALTNVASGTSEHTRVVIDHGAVPMFVQLLSSGSDDVREQAVWALGNVAGDSPSCRDLVLGHGALMPLLAQLNENSKLSMLRNATWTLSNFCRGKPPTPFDQVKPALPVLQQLIHLNDEEVLTDACWALSYLSDGQNDKIQAVIDAGVCRRLVELLLHPSPTVLIPALRTVGNIVTGDDGQTQFVIDNQVLPCLHQLLLQNHKKSIKKEACWTISNITAGNRTQIQAVIEANIILPLVNLLQHAEFDIKKEAAWAISNATSAGSHEQIQFLVSQGCIKPLCDLLICPDPRIVTVCLEGLENILKVGEADKEMGLNGGVNLYAQMVDECDGLDKIENLQTHDNNEIYEKAVKILERYWAEEEDGEPIVQDGGDGNQQGFAFGTNQPSVPQGGFKFG

SEQ ID NO: 245 - DNA, 1590 bp, Solanum lycopersicum
atgtcgttgaggccgaacgccagaaccgaggttcgccggaaccgttacaaagttgccgttgatgccgaggaaggtcgccggagaagagaggacaatatggttgagattcgtaagaataagagagaggagaacttgcagaagaagcgacgtgaaggccttcaagctaatcagcaattttctgttcctgttcagtccactgtcgaaaagaagctcgagaatttaccagcaatggttgccggtgtttggactgaagatggcaatcttcagcttgaagctactactcagtttcgaaaactgctttccatagaaaggagtcccccaattgaggaggtaattcaagcaggtgttgttcctcggtttgttcaatttcttataagggatgactttccacaacttcagtttgaggcagcatgggctctcacaaatattgcttcggggacatctgaacataccaaggtggtgattgaatctggtgcagtcccaatttttgtgaaacttcttagttctccaagtgatgatgtgcgtgagcaggctgtttgggctcttggaaatgttgctggtgattccccaaaatgccgtgatcttgtccttaactgtggagctttgcttcccttgctgtctcagctgaatccaaatgccaagctctctatgttgagaaatgcaacctggacactttcaaatttctgcagaggcaaaccacagcctgcttttgatcagacgaagcctgcacttccagctcttcaacaactaattcattcaaccgatgaagaagttttgactgatgcttgctgggcactttcatatctctctgatggtacaaatgataaaattcaagctgttattgattctggagtatgcccacgattagtcgagttattacttcacccatctccatcggttttgattcctgctcttcggactgttgggaatattgtgacaggagatgatatgcaaactcagtgtatcatcggccatcaggctttgccctgtcttttgaacttgttgagtggtagtcacaagaagagtattaagaaggaagcttgctggacaatttctaacatcacggctggcaaccgggagcaaattcagtgtgtggttgacgctggtattataggtccccttgttaatttgctacaaaatgcggagtttgaaataaaaaaggaggctgcatgggcaatttcaaatgccacatctggtggttcacatgagcagatcaagtaccttgttagtcaaggttgtatcaagccattgtgtgatcttctcatttgtcctgacccaaggattgtcacagtttgtcttgaagggcttgaaaatattttgaaggttggggaagctgagaagagtttgggccggacatcagatataaatctttatgctcagctgattgatgacgctgaaggtttagaaaaaattgagaatcttcaaagccatgacaatcaagagatctatgaaaaggcagttaagattcttgagacgtactggttggaagaagatgacgagaccatgccacctggtgatgcagcccaacaaggttttcagtttggaggtggtgaggtttctgtgccctctggaggattcagctttaactaa

SEQ ID NO: 246 - protein, 529 aa, Solanum lycopersicum
MSLRPNARTEVRRNRYKVAVDAEEGRRRREDNMVEIRKNKREENLQKKRREGLQANQQFSVPVQSTVEKKLENLPAMVAGVWTEDGNLQLEATTQFRKLLSIERSPPIEEVIQAGVVPRFVQFLIRDDFPQLQFEAAWALTNIASGTSEHTKVVIESGAVPIFVKLLSSPSDDVREQAVWALGNVAGDSPKCRDLVLNCGALLPLLSQLNPNAKLSMLRNATWTLSNFCRGKPQPAFDQTKPALPALQQLIHSTDEEVLTDACWALSYLSDGTNDKIQAVIDSGVCPRLVELLLHPSPSVLIPALRTVGNIVTGDDMQTQCIIGHQALPCLLNLLSGSHKKSIKKEACWTISNITAGNREQIQCVVDAGIIGPLVNLLQNAEFEIKKEAAWAISNATSGGSHEQIKYLVSQGCIKPLCDLLICPDPRIVTVCLEGLENILKVGEAEKSLGRTSDINLYAQLIDDAEGLEKIENLQSHDNQEIYEKAVKILETYWLEEDDETMPPGDAAQQGFQFGGGEVSVPSGGFSFN

SEQ ID NO: 247 - DNA, 1230 bp, Triticum aestivum
atgtcgctgcggcccaacgagcgggccgaggtgcggcgcagccgctacaaggcgtccgtcgacgccgaggacgggcgccgccggcgggaggatcagatggtggagatccggaagaatcagcgcgacgcgaacctccagaagaagcgccgcgacgggttcccggccggcgccgcgtccgctgccggtggcgcgccgcagatgggccactcctcggctctccagcagaagctggagggcttgcccgcgatggtgcaggcggttctctcggacgacaacgccgtgcagctcgaggccaccacccagttccggaagctgctctccatcgagcgaagccctccaattgaggaagtgatcaacacaggcgtggtgcctcgcttcattgagttcctcacacgggaggactatccccaactccagtttgaggctgcatgggcgctcaccaacatcgcgtcaggcacatcagacaacaccaaagtggtggttgagtatggtgctgtgcccatctttgtcaagctactcagctctcctagtgaggatgtccgcgaacaggctgtttgggctctggggaatgttgctggtgactctccaaagtgccgtgaccttgtgcttggaagtggtggtctgttccctttgttgcagcagctcaatgagcatgccaagctctcgatgctcaggaatgccacatggacactctccaacttctgccgtgggaaaccacagccaaactttgaacaggtcaaaccggctctctcagcactgcagcgccttatccactctcaggatgaggaggtgctcactgatgcctgctgggctctctcgtacctgtctgatggaactaatgacaagatccaatccgtgattgagtctggtgtttttcctcgccttgtggagcttctcttgcacccttcggcttctgttctcattccagctctgcgcacggtgggtaacattgtcactggtgatgatttgcagactcagtgtgtcattgatcaccaagcacttccctgtctcttgaacctcttgactaccaaccacaagaaaagcatcaagaaagaagcatgctggacaatctcaaacatcacagctggtaaccgggaccagattcaggctgtcatccaggcaaacattattggtcctctggtccatctcctgcaaggtgctgaatttgacattagaaggaggcggcctgggcatttcaaatgccactctggtggacacatgaccagatag

SEQ ID NO: 248 - protein, 409 aa, Triticum aestivum
MSLRPNERAEVRRSRYKASVDAEDGRRRREDQMVEIRKNQRDANLQKKRRDGFPAGAASAAGGAPQMGHSSALQQKLEGLPAMVQAVLSDDNAVQLEATTQFRKLLSIERSPPIEEVINTGVVPRFIEFLTREDYPQLQFEAAWALTNIASGTSDNTKVVVEYGAVPIFVKLLSSPSEDVREQAVWALGNVAGDSPKCRDLVLGSGGLFPLLQQLNEHAKLSMLRNATWTLSNFCRGKPQPNFEQVKPALSALQRLIHSQDEEVLTDACWALSYLSDGTNDKIQSVIESGVFPRLVELLLHPSASVLIPALRTVGNIVTGDDLQTQCVIDHQALPCLLNLLTTNHKKSIKKEACWTISNITAGNRDQIQAVIQANIIGPLVHLLQGAEFDIRRRRPGHFKCHSGGHMTR

SEQ ID NO: 249 - DNA, 1584 bp, Zea mays
atgtcgctgcgtccgagcgagcgggtcgaggtacggcggaaccgctacaaggtggcggttgacgcggaggaggggcggcggcggcgcgaggacaatatggtggagatccgcaagagccgccgtgaggagagcctcctcaagaggcgccgtgaggggctccaggcccaggtccctgcccctccctccggggttgagaagaagcttgaaagcctcccagctatggttagtggggtttattcggatgataataaccttcagcttgaggccaccacacagttccgcaaattgctctctatagagaggagtccccccatcgaagaagttatcaaaacaggtgtagttccaagatttgtgcagtctctcaccagagaggatttcccccagctgcagtttgaagccgcatgggctctcacaaatattgcttctggcacttcagaaaatacaaaggctgttattgaccatggggctgttcctatatttgtgaagcttcttgggtctggtagtgatgatgttcgtgagcaggctgtgtgggctttgggtaatgttgctggcgattctccgaagtgccgcgaccttgttctcgccaatggtgcgttgatgcctctgctagcccagttgaatgagcatgttaagctctccatgctgcggaatgccacctggactttgtctaacttctgcaggggaaaaccacagccatcatttgatcagactaagcctgctctgccagcacttgcacgacttatccattccaacgacgaggaagttctcactgatgcatgctgggccctgtcatacttatctgacggcactaatgataagatccaggctgtgattgaagctggtgtttgcccccggctcgtggagcttctcctccatccatcaccatcggtgcttatacctgctctacgaactgttgggaatattgtcactggagatgatttgcaaactcagtgtattattgatcatcaagctcttccccgcctcgtgaatctgttgacgcagaaccacaagaaaagcattaagaaagaggcatgctggactatttcaaatattactgctggaaacaaagatcagatacaggctgtcataagtgccggtatcatcgctcctttgttgcaactgcttcaaacagcagagtttgatatcaagaaggaggctgcttgggccatctcaaatgctacccctggtggttctcatgagcaaatcaagtacttggtgtctgagggctgcatcaagccattgtgtgaccttcttgtctgccctgatccgagaattgtaacagtttgtctggagggtcttgagaatattcttaaagtagggcagcatgacaagaccatgggtgcaacaggtgacactaatgtcttagctcagatgattgatgaagcggaaggcctggaaaagatcgagaacctacagagccacgataacaatgaaatctatgaaaaggctgtgaagcttcttgagacatactggatggaggaggaagatgacgcaatggctactgccggggaagctgctcctgctgtttttgactttaaccaaggtggcaaccctcctggtgctggtggtctgaacttcaactga

SEQ ID NO: 250 - protein, 527 aa, Zea mays
MSLRPSERVEVRRNRYKVAVDAEEGRRRREDNMVEIRKSRREESLLKRRREGLQAQVPAPPSGVEKKLESLPAMVSGVYSDDNNLQLEATTQFRKLLSIERSPPIEEVIKTGVVPRFVQSLTREDFPQLQFEAAWALTNIASGTSENTKAVIDHGAVPIFVKLLGSGSDDVREQAVWALGNVAGDSPKCRDLVLANGALMPLLAQLNEHVKLSMLRNATWTLSNFCRGKPQPSFDQTKPALPALARLIHSNDEEVLTDACWALSYLSDGTNDKIQAVIEAGVCPRLVELLLHPSPSVLIPALRTVGNIVTGDDLQTQCIIDHQALPRLVNLLTQNHKKSIKKEACWTISNITAGNKDQIQAVISAGIIAPLLQLLQTAEFDIKKEAAWAISNATPGGSHEQIKYLVSEGCIKPLCDLLVCPDPRIVTVCLEGLENILKVGQHDKTMGATGDTNVLAQMIDEAEGLEKIENLQSHDNNEIYEKAVKLLETYWMEEEDDAMATAGEAAPAVFDFNQGGNPPGAGGLNFN

SEQ ID NO: 251 - DNA, 1329 bp, Brassica napus
atgtacggcggagatgaagtgtcagctatagtggttgacttgggctcgcacacttgcaaggctggttacgccggcgaagatgctcccaaggccgtcttcccttccgttgttggggcggtagatggaagtgaggcgatggatgtggatgctgattctgcgaagaacaattcgaactcagaggattcgaagacgaacgagcctgacaaagaaaaggggaaacgtaagctgtatgtgggatctcaggccttgaattaccgccgagatcatatggagatattgtcacccatcaaagatggcatagtttctgattgggatttggtggacaacatttgggaacatgcgttcaggggttgtctgatgattgatcctaaggagcaccccatgctgctagctgagcctcctttaaacacccaacagcagagagagaaggcggcagagctaatgtttgaaaaatacaaagttccagctttgtttatggctaagaatcctgttctcacgtcttttgctactgggcgtgctacttcattggttgtggactgcggtggaggatccacaaccatatcaccggtgcatgagggttatgtccttcaaaaggcggttgtatcagctccaattggaggggagtttctcactgactgcttactgaaaagcttggagagtaaaggaatcaaaataaggcctagatactctttcaagagaaaggaagtacgaccaggggaattccaggttgaggatgtaggtgttcctgacaccacggaaagctacaagctcttctgtcagaggatgatagtgggtgatatcaaggattctatttgtcgtgttcctgatactccttatgacgacaaatcatatgcaaacatcccaactacgtcatacgagcttcctgatggccagacgctcgagatcggtgctgataggttcaagattcctgatgtgatgttcaacccgtcaatagttcagacaattcctgggatggagaagtatggagacatgattcctactgttcgtgggttgccacacatggtcatggagagcatcaacaaatgtgatgtggatatccggagagagttgtatagtagcatactgcttgctggtggcacatcatcgatgcaacaattgaaagaacgcctcgaaaaggacttgatagaagaatctcctcactcggctcgagttaaagtgttggcgagcggtaacacaacagaaagaagattcagtgtatggataggagggagtatattggcatcactgggctcattccaacagatgtggttctccaaatctgagtacgaggaacatggcgcttcgtacattcagagaaagtgcccttaa

SEQ ID NO: 252 - protein, 442 aa, Brassica napus
MYGGDEVSAIVVDLGSHTCKAGYAGEDAPKAVFPSVVGAVDGSEAMDVDADSAKNNSNSEDSKTNEPDKEKGKRKLYVGSQALNYRRDHMEILSPIKDGIVSDWDLVDNIWEHAFRGCLMIDPKEHPMLLAEPPLNTQQQREKAAELMFEKYKVPALFMAKNPVLTSFATGRATSLVVDCGGGSTTISPVHEGYVLQKAVVSAPIGGEFLTDCLLKSLESKGIKIRPRYSFKRKEVRPGEFQVEDVGVPDTTESYKLFCQRMIVGDIKDSICRVPDTPYDDKSYANIPTTSYELPDGQTLEIGADRFKIPDVMFNPSIVQTIPGMEKYGDMIPTVRGLPHMVMESINKCDVDIRRELYSSILLAGGTSSMQQLKERLEKDLIEESPHSARVKVLASGNTTERRFSVWIGGSILASLGSFQQMWFSKSEYEEHGASYIQRKCP

SEQ ID NO: 253 - DNA, 1338 bp, Glycine max
atgtatggcggtgatgaagtatcagctatagtagttgacttgggttcacacacttgtaaagctggttatgctggtgaagatgctcccaaggccgtgtttccctctgttgtgggagcaattgatcaaatggatgttgatgaagcagataatggcgaaaacaactctgcctctgctccggaatcaaataataatgttagaaatgctgattctgacaagaccaagggaaagaggaaattgtatgtaggatcccagtccttggggtaccgtagagaccatatggaggtgctgtctccgtttaaagacgggattgttgctgactgggatattgttgacagcatatgggatcacgccttcagggaatgcctattgattgatcctaaagagcatcctatgcttcttgcagagccttcttctaactctcaacaacagagagaaaggacagcagagctgatgtttgagaagtacaaagcacctgcattgtttttggcgaagaatgctgttctgacttcttttgcatcagggcgtgctacgtcattagttgttgatggtggtggaggatcaattacagttgcaccagtacatgatggttatgttcttcaaaaggctgtggctacctctccaatgggaggagaatttcttacagactgcttgatgaaaagcttggaaagcaagggtattacgataaaaccaaggtattcctttaggagaaaggaaatacgtcctggagagtttcagacagtagatcttgagtttccaaatacaactgaaagctacaaactctattgccagagggtgattgctagtgatatcaaggaatgtgtgtgtcgtgctccagatactccatatgatgagagtgcatattctaacatcccaatgacctcatatgagcttcctgatggccagacaattgaaattggagctgacagatttaagattccagatgttcttttcaatccgtccctggttcagtcaattcctggcacagagagctttgcagaaattgctccttcagttcgtggcctgcctcaaatggtgattgaaagcattaataagtgtgatgtagacattcgaagagagttgtttagtagtatactgcttgctggtggcacagcttcaatgcaacagctaaaggaacgccttgagaaagacttgctagaggagtcccctcaagctgccagagtaaaagtattagccagcggaaatgctactgaaagaaggtttagtgtttggattgggggtagtatattggcatcacttggctccttccagcaaatgtggttctccaaatccgagtatgaagagcatggagcttcatatatccaaaggaagtgtccatga

SEQ ID NO: 254 - protein, 445 aa, Glycine max
MYGGDEVSAIVVDLGSHTCKAGYAGEDAPKAVFPSVVGAIDQMDVDEADNGENNSASAPESNNNVRNADSDKTKGKRKLYVGSQSLGYRRDHMEVLSPFKDGIVADWDIVDSIWDHAFRECLLIDPKEHPMLLAEPSSNSQQQRERTAELMFEKYKAPALFLAKNAVLTSFASGRATSLVVDGGGGSITVAPVHDGYVLQKAVATSPMGGEFLTDCLMKSLESKGITIKPRYSFRRKEIRPGEFQTVDLEFPNTTESYKLYCQRVIASDIKECVCRAPDTPYDESAYSNIPMTSYELPDGQTIEIGADRFKIPDVLFNPSLVQSIPGTESFAEIAPSVRGLPQMVIESINKCDVDIRRELFSSILLAGGTASMQQLKERLEKDLLEESPQAARVKVLASGNATERRFSVWIGGSILASLGSFQQMWFSKSEYEEHGASYIQRKCP

SEQ ID NO: 255 - DNA, 1134 bp, Gossypium hirsutum
atggctgatggtgaggatattcaaccacttgtctgcgacaatggaactggaatggtcaaggctggatttgctggtgacgatgctccaagggctgtgttccctagcatcgtggggcgtccacgtcacactggtgtgatggttggtatgggtcaaaaagatgcatatgttggggatgaggctcagtccaaacgtggtattttaactctgaagtatccgattgaacacggtattgttaacaactgggatgatatggaaaagatttggcatcataccttttataatgaacttcgtgtggctccagaagaacatccggttcttcttaccgaggcacctcttaaccctaaagccaatcgtgagaaaatgacccaaatcatgtttgagaccttcaatgctccggctatgtatgttgctatccaggctgttctctccctatatgccagtggtcgtacaactggtattgttttggactctggagatggggtgagtcatactgtccccatatatgaaggatatgccctccctcatgccatcctccgtctcgacttagcgggtcgtgatcttactgatgcccttatgaaaatcttgactgaacgtggttattcattcaccactacagctgagcgtgaaattgtgagggatgtgaaagagaagctggcatatattgcactcgactatgaacaagagctagaaacttccaaaactagttcttccattgagaagagctacgagttgcctgatggccaagtgatcaccatcggcgctgagcgcttccgatgcccagaagtccttttccaaccttccatgattggaatggaagctgctggcattcatgaaaccacctacaactctatcatgaagtgcgatgtcgacattaggaaggatttgtatggaaacattgttctcagtggtggaactactatgttccctggaattgctgatagaatgagcaaggaaatcactgccttagccccaagcagcatgaaaattaaggtggtggctccacctgaaaggaaatacagtgtctggattggaggctccatcttagcatctctcagtactttccagcagatgtggattgctaaggcggagtacgatgaatccggcccctctattgtgcacaggaagtgcttctaa

SEQ ID NO: 256 - protein, 377 aa, Gossypium hirsutum
MADGEDIQPLVCDNGTGMVKAGFAGDDAPRAVFPSIVGRPRHTGVMVGMGQKDAYVGDEAQSKRGILTLKYPIEHGIVNNWDDMEKIWHHTFYNELRVAPEEHPVLLTEAPLNPKANREKMTQIMFETFNAPAMYVAIQAVLSLYASGRTTGIVLDSGDGVSHTVPIYEGYALPHAILRLDLAGRDLTDALMKILTERGYSFTTTAEREIVRDVKEKLAYIALDYEQELETSKTSSSIEKSYELPDGQVITIGAERFRCPEVLFQPSMIGMEAAGIHETTYNSIMKCDVDIRKDLYGNIVLSGGTTMFPGIADRMSKEITALAPSSMKIKVVAPPERKYSVWIGGSILASLSTFQQMWIAKAEYDESGPSIVHRKCF

SEQ ID NO: 257 - DNA, 1134 bp, Hordeum vulgare
atggctgacgccgaggacatccagcccctcgtctgcgacaatggaaccggcatggtcaaggctgggttcgcaggagatgatgcgccaagggctgtcttcccaagtatcgtgggccgcccacgccacaccggtgtcatggtcgggatggggcagaaagacgcatacgtcggtgacgaggcccaatccaagaggggtatcctcaccctcaagtaccccatcgagcacggtatcgtcagcaactgggacgatatggagaagatctggcatcacaccttctacaacgagctccgtgtcgccccagaggagcaccccgtccttctcactgaggcgccgctcaaccccaaggccaatcgtgagaagatgacccagatcatgttcgagaccttcaacactcctgctatgtatgtcgccatccaggccgtcctctcgctgtatgccagtggtcgtaccacaggtattgtgctggactcgggagatggtgtcagccacactgtccccatctacgaaggatacgctcttccccacgctatcctccgtcttgacctggctgggcgtgatctcaccgattacctcatgaagatcctcactgagcgtggttactcattcaccaccactgctgagcgggaaattgtgagggatgtgaaggagaagctgtcctacattgcactggactacgaccaggaaatggagacttccaagaccagctcttctgtggagaagagctacgagcttcctgatgggcaggttatcaccattggttccgagcgtttccgttgccctgaggtcctcttccagccatccttcatcgggatggaagctgcaggtatccatgagaccacctacaactccatcatgaagtgtgacgtggatattaggaaggatctgtacggcaacattgttcttagtggtggtaccactatgttcactggaatcgctgataggatgagcaaggagatcactgccttggctcctagcagcatgaagattaaggttgttgctcctcctgaaaggaagtacagtgtctggatcggaggatccatcttggcatctctcagcaccttccagcagatgtggattgcaaaggctgagtacgacgagtctggcccatccatcgtgcacaggaaatgcttctaa

SEQ ID NO: 258 - protein, 377 aa, Hordeum vulgare
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDYLMKILTERGYSFTTTAEREIVRDVKEKLSYIALDYDQEMETSKTSSSVEKSYELPDGQVITIGSERFRCPEVLFQPSFIGMEAAGIHETTYNSIMKCDVDIRKDLYGNIVLSGGTTMFTGIADRMSKEITALAPSSMKIKVVAPPERKYSVWIGGSILASLSTFQQMWIAKAEYDESGPSIVHRKCF

SEQ ID NO: 259 - DNA, 1920 bp, Medicago truncatula
atgtacgatggtgatgaagtttcagctatagtaattgatctgggttcacatacttgtaaagctggttatgctggtgaagatgctcccaaagctgtgtttccttctcgttattattattttgttctttttgtcgttgctgatgatagtgatgaagcgggcactgagattgaggccaattgcaagaaaccttttttgtggatcactaggcctaatcttgtcattggtggctcagtggttttgtcatctgagtttaggaaagaaatttcagatagaggcctaatatcaaattggtgtccacaagagaaagttttgaaccacccttcaatcagcgggttcttgactcactgcggatggaactcaaccaccgaaagcatatgcgctggagtgccaatgttgtgttggtcattttttgctgatcagccaacaaactgtagatttatttgtaatgaatggaagattggtatggaaattgatatgaatgtgaagatagaggatttggagaagcttatcaatgaattgatggtgggagagaatggaaaaaagatgaggcaaaaggccatggagttgaagaaaaaggcagaggagaacactagaccagatgaagtttcagctatagtaattgatttgggttcacatacctgtaaagctggttatgccggtgaagatgctcccaaagctgtgtttccttctgttgttggagcgattgatcaaatggacgtcgatgaatcagatgatgctgaaaagaactctggctctggtgaatcaaagaacaatattagaaatgttgacggtgataaagccaagggaaagagaaaattgtatgtaggatctcagtccttgggctaccgtagagattttatggaggtggtgtctccattaaaggatggaattgttgctgactgggatattgttgacagcatttgggatcatgccttcagggagtgtctactgattgatcctaaagagcatcccatgctccttgcagagccttcttctaatgctcaacaacagagagaaagggcagcagagcttatgtttgagaagtacaaagcacctgcattatttttggcaaaaaatgctgttttgacttcttttgcatcagggcgtgccacatcattagttgttgattgtggtggaggatcaactacagttgcaccggtacatgatggctatgttcttcagaaggctgtggcgacgtctccaattggaggagaatttcttacagattgcttgatgaaaagcttggaaagcaagggtattgcgatgaaacctcggtattcctttaggagaaaagaaatacgccctggagagtttcagactgtagacttggattttcctaatacgtctgaaagctacaagctctattcccagagggtgattgctagtgatatcaaggaatgtgtgtgccgtgctccagatactccatatgatgagagtgcatattcaaacatcccaacgacgtcgtatgagcttcctgatggccagacaattgaaattggagctgacagatttaagattccagatgttcttttcaatccatccctggctcattcaattccgggcatggagagctttgcagaaatcgctccatcagttcgtgggctgcctcaaatggttatcgatagcattaataagtgtgacgtagacattcgaagagaattatttagtagcatactgcttgctggtggcacggcttcaatgcaacaactgaaggaacgccttgagaaagacttgctagaggaatcccctcaggctgctagagtaaaggtattggccagtggaaatgctactgaaaggaggtttagtgtctggattggaggcagtatattggcttctcttggttccttccaacagatgtggttctccaaatccgagtatgaagagcatggagcttcatatatccaaaggaaatgtccttga

SEQ ID NO: 260 - protein, 639 aa, Medicago truncatula
MYDGDEVSAIVIDLGSHTCKAGYAGEDAPKAVFPSRYYYFVLFVVADDSDEAGTEIEANCKKPFLWITRPNLVIGGSVVLSSEFRKEISDRGLISNWCPQEKVLNHPSISGFLTHCGWNSTTESICAGVPMLCWSFFADQPTNCRFICNEWKIGMEIDMNVKIEDLEKLINELMVGENGKKMRQKAMELKKKAEENTRPDEVSAIVIDLGSHTCKAGYAGEDAPKAVFPSVVGAIDQMDVDESDDAEKNSGSGESKNNIRNVDGDKAKGKRKLYVGSQSLGYRRDFMEVVSPLKDGIVADWDIVDSIWDHAFRECLLIDPKEHPMLLAEPSSNAQQQRERAAELMFEKYKAPALFLAKNAVLTSFASGRATSLVVDCGGGSTTVAPVHDGYVLQKAVATSPIGGEFLTDCLMKSLESKGIAMKPRYSFRRKEIRPGEFQTVDLDFPNTSESYKLYSQRVIASDIKECVCRAPDTPYDESAYSNIPTTSYELPDGQTIEIGADRFKIPDVLFNPSLAHSIPGMESFAEIAPSVRGLPQMVIDSINKCDVDIRRELFSSILLAGGTASMQQLKERLEKDLLEESPQAARVKVLASGNATERRFSVWIGGSILASLGSFQQMWFSKSEYEEHGASYIQRKCP

SEQ ID NO: 261 - DNA, 1332 bp, Oryza sativa
atgtacggcggcgatgaggtctcggccatcgtcatcgacgtggggtcctacagctgcaaggcggggtacgccggtgatgacacccccaaggccgtcttcccctcggttgttggttcaattgagcaaacgggagaaactgatgaagcaaaggcagacaaggaggctgaagctgcatcagattctaagaatggagccaaacctatggatgtggacaaagccaagacaaagcgcaaattgtatgttggtcaagaattggagttcaggagggatcatatggaggtgatttcaccaatgaaagatggaacagttactgattgggatattgttgacaatatatggaatcatgctttcaggcagcggctattgatcaatcctgaggagcatcctatgttgatagctgaaccatctacaaacacaggacagcaaagagagaaagcagcagaacttatgtttgagaagtacaaagtgccggcactgttcctagcgaaaaatgcagttctcacatcttttgcatctggacgtgctacatcgttggtagttgacagcggtggtgggtctactgtggttgctgctgttcacgatggttatgtattgcaaaagtctgtggcgacttctccaattggtggtgaatttttaactgactgtatgatgaaaagcttggagagcaagggcgttgttataaggcccaggtattcattcaagaagaaggaagtcggccctggcgaatataaggttgtagatcttgatcttccaaacacaacggagagttacaagttatactgcatgagagctattgctagtgatatcaaggagtcagtttgcagggttccagatactgccttcgatgaagtggcatatgcaaacgttcctacaacttcatatgagcttccagatggacaaaccattgaagttggtgcagacagattcaagattcctgatattctgtttaatccatctctttctcagactattcctggagttgatggatttgcagattcaatgtcagttcgtggccttccacgaatggtcattgatagtgtaaataggtgcgatgttgacattcgcaaggaactgctaagcagtattctgctttcaggtggttcatcatcaattctgcagttgaaggagaggctagaaaaagaagtacttgaggaatcttctggtaatactcgtgtaaaggttttggcaagtggaaattcagtagagaggcgattcagtgtttggattggagggagcattctagcatcccttgggtcgttccagcaaatgtggttctccaaagcagaatacgaagaacatggagtatcctacatccaaaggaagtgcccatga

SEQ ID NO: 262 - protein, 443 aa, Oryza sativa
MYGGDEVSAIVIDVGSYSCKAGYAGDDTPKAVFPSVVGSIEQTGETDEAKADKEAEAASDSKNGAKPMDVDKAKTKRKLYVGQELEFRRDHMEVISPMKDGTVTDWDIVDNIWNHAFRQRLLINPEEHPMLIAEPSTNTGQQREKAAELMFEKYKVPALFLAKNAVLTSFASGRATSLVVDSGGGSTVVAAVHDGYVLQKSVATSPIGGEFLTDCMMKSLESKGVVIRPRYSFKKKEVGPGEYKVVDLDLPNTTESYKLYCMRAIASDIKESVCRVPDTAFDEVAYANVPTTSYELPDGQTIEVGADRFKIPDILFNPSLSQTIPGVDGFADSMSVRGLPRMVIDSVNRCDVDIRKELLSSILLSGGSSSILQLKERLEKEVLEESSGNTRVKVLASGNSVERRFSVWIGGSILASLGSFQQMWFSKAEYEEHGVSYIQRKCP

SEQ ID NO: 263 - DNA, 1317 bp, Physcomitrella patens
atgtacgggggagatgaggtttcggcgatagtgctggaccttggttcacactcctgcaaagcaggttatgcaggtgaagatcaacccaagtctgtattcccatctgtagtaggctcagtggagaccccaggagcggtggtcgatgggggaggagacacagacatggaggctaagaagtctggagaagccgaaaaggctaagtcgaggaaactgtatgctggtgtgcaagctctgggttatcgcagagattacatggaggttgtaccggctatgaaggatggcctcgttgcagattgggatgttgtagaaagtctttgggatcacgctctaagggatcgtttaatgatagacccaaaggagcatccaatgcttctcgcagagccctcattcaacacacaacaacatcgcgaaaaaatggttgaacttatgttcgagaagtacgacgtaccagccctttttctcgccaagaatgcggttttgacatcctttgcatcaggccgagcaacatcgctcgttgtggactgcgggggaggctcaaccaccgtggctgcagtgcatgacggttatgtccttcagaaggctatagttcgatcggcaattggaggggaagttctcacagattgcctccaacgaacattggaagccaaaggcattaagatcaaaccacgtttctcatttaagcgcaaagagatacgtcagggggaatacgagttgatcccactcgatcttccaaacacgacagacagctactacgcttatgcgcagagagctattgtggctgatattaaagaatccatttgccgtgtaccagattcagcttttgatgaaacttcatatgctaatatcccaacaacaccttatgagcttccagacggccagataattgaaattggagctgatcgtttcaagatttcagacattttgttcaatcctactcttattcagacaattcctggcatggagaaattcggcactgaagctggaataccttttaacggacttcctcaaatggtgattgagagcatcaacaaatgtgatgttgatatacggagagagctcttcaacagtgtgatgcttgccggtgggactgcttctatgcatcagatgaaggagaggctagaaaaggatctcatggaagaggcaccacaagctgcacgtgtgaaagtgttggccagcggtaacgtcttggagcgtcgattcagtgtatggattggtggaagtattttggcttcattgggctcttttcagcaaatgtggttctccaaagcagagtatgaagagcatggtcccacatatgttcagagaaagtgcccataa

SEQ ID NO: 264 - protein, 438 aa, Physcomitrella patens
MYGGDEVSAIVLDLGSHSCKAGYAGEDQPKSVFPSVVGSVETPGAVVDGGGDTDMEAKKSGEAEKAKSRKLYAGVQALGYRRDYMEVVPAMKDGLVADWDVVESLWDHALRDRLMIDPKEHPMLLAEPSFNTQQHREKMVELMFEKYDVPALFLAKNAVLTSFASGRATSLVVDCGGGSTTVAAVHDGYVLQKAIVRSAIGGEVLTDCLQRTLEAKGIKIKPRFSFKRKEIRQGEYELIPLDLPNTTDSYYAYAQRAIVADIKESICRVPDSAFDETSYANIPTTPYELPDGQIIEIGADRFKISDILFNPTLIQTIPGMEKFGTEAGIPFNGLPQMVIESINKCDVDIRRELFNSVMLAGGTASMHQMKERLEKDLMEEAPQAARVKVLASGNVLERRFSVWIGGSILASLGSFQQMWFSKAEYEEHGPTYVQRKCP

SEQ ID NO: 265 - DNA, 1326 bp, Populus trichocarpa
atgtacggtggtgatgaagtgtcagctatagtcattgacttgggttctcacacttgcaaagctggttatgccggcgaggacgcacccaaggccgtctttccttctgttgtgggatcaattgatcaaatggatgttgatgacatgacaagcaacgagaagaatgctgctgtagattctaaaaataatgtcaaagattctgagaaagggaagggaaaacgtaaattatttgtaggatctcaggccttagggtttcgtcgggaccatatggaggtgttatccccttttaaggatgggattgttgctgactgggatattgtggatagcatatgggatcatgctttcagggagtgtctattgattgatccaaaggagcatccaatgctacttgcagaaccttcatccaacagtcaacaacagagagaaaggacagcagagcttatgtttgaaaagtacactactcctgcattatttttggcgaagaatgctgttttaacatcttttgcatcaggacgtgctacctcgctagttgttgatagtggtggaggatcaactacaattgcaccagtccatgatggttatgttattcaaaaggctgtggccttttctcctattgggggagaacttcttactgattgcttgatgaaaagcttggagagcaaaggtgtcatgataaaaccaaggtactctttcaaaaggaaggaaatacagccgggcgtgtttcagactgtggatcttgattttacaaatacaactgacagctacagactctactctcagagagtgattgcaagtgatatcaaggaatgtgtgtgtcgtgcaccggatacgccctatgatgaaagttcatactcaaacattccaatgactccatatgagcttccggatggccagacaattgaaattggagctgatagattcaagattccagatattctattcaatccatccttggtccagacaattcctggtatggataattttgtggagattgctcctagtgttcgcggtttgccacaaatggttattgaaagcattaataagtgtgatgttgatattcgaagagaactgttcagtagtatactgcttgctggtggaacagcatcaatgcaacagttgaaggaacggcttgagaaagatttgcttgaggagtctcctcaagctgccagagttaaagtgctggctagtggaaatgcaactgaaaggagattcagtgtctggataggagggagtatattggcatctcttggttcattccagcagatgtggttctccaaggccgagtatgaagagcatggggcgtcttatgtacagagaaaatgcccttga

SEQ ID NO: 266 - protein, 441 aa, Populus trichocarpa
MYGGDEVSAIVIDLGSHTCKAGYAGEDAPKAVFPSVVGSIDQMDVDDMTSNEKNAAVDSKNNVKDSEKGKGKRKLFVGSQALGFRRDHMEVLSPFKDGIVADWDIVDSIWDHAFRECLLIDPKEHPMLLAEPSSNSQQQRERTAELMFEKYTTPALFLAKNAVLTSFASGRATSLVVDSGGGSTTIAPVHDGYVIQKAVAFSPIGGELLTDCLMKSLESKGVMIKPRYSFKRKEIQPGVFQTVDLDFTNTTDSYRLYSQRVIASDIKECVCRAPDTPYDESSYSNIPMTPYELPDGQTIEIGADRFKIPDILFNPSLVQTIPGMDNFVEIAPSVRGLPQMVIESINKCDVDIRRELFSSILLAGGTASMQQLKERLEKDLLEESPQAARVKVLASGNATERRFSVWIGGSILASLGSFQQMWFSKAEYEEHGASYVQRKCP

SEQ ID NO: 267 - DNA, 1308 bp, Solanum lycopersicum
atgtacggtggtgatgaagtgtcagcaattgtgatagatttgggtagccatacttgcaaagctggttacgctggggaagatgctcccaaagccgttttcccatctgctgttggatcggttgatgaaatggaagttgataatcctgataatccagaggataattctggatctgctcctgaccttaaatcaaagggtaagcggaaattgtatgttggatctcaagccttgggatttcgccgtgatcacatggaggtgatatcacccatcagggatgggatggttgtggactgggatattgtagaaaacatatgggaccatgcttttagggaatgcttactgatcgatccaaaggagcatccaatgttacttgcagagccttgttcaaacactcagcagcagagggaaaaggctgcagagataatgtttgaaaaataccaagttccagcattgtttttggccaaaaatgctgttctcacatctttcgcatcaggacgtgcaacttctttggttgttgacagtggtggaggattgactactgttgctccggttcatgatggatgcgttcttcaaaaggcggtttgtacatctcctattgggggtggaattcttaccgattgcttgataaaaagtttggaacagaaaggcattacgataaaacctaggtattcattcaagcggaaggagatccgtccaggagaatttcagacagtggaccttgatttccctgatacaaccgagagttacaagctatattgtcagagagcgattgcaagtgacataaaagaatgcgtctcccgagccccagatactccatatgatgacagttcatattcgaacattccaacgacatcttatgagctacctgatgggcagataatagaagtcggagcagatagattcaagattcctgatattatattcaatccatcattggttcagactattcccggtatggaaagttttgctgaaactgccgcttcccttcgtggtcttccacaaatggttatagatagcataaacaagtgtgatgtggatattcgaagagaactttttagcagtatattgcttgctgggggaacagcatcgatgcaacaactcaaagaacgtctggagaaggacttgctagaggagtctcctcaggcagcgagagtcaaagtcctggctagtggaaatgctacagaaaggagattcagtgtttggatagggggcagcattctggcatctcttggctcctttcaacaaatgtggttttcaaagtccgagtacgaagagcatggggcatcttacgttcaaagaaaatgcccttaa

SEQ ID NO: 268 - protein, 435 aa, Solanum lycopersicum
MYGGDEVSAIVIDLGSHTCKAGYAGEDAPKAVFPSAVGSVDEMEVDNPDNPEDNSGSAPDLKSKGKRKLYVGSQALGFRRDHMEVISPIRDGMVVDWDIVENIWDHAFRECLLIDPKEHPMLLAEPCSNTQQQREKAAEIMFEKYQVPALFLAKNAVLTSFASGRATSLVVDSGGGLTTVAPVHDGCVLQKAVCTSPIGGGILTDCLIKSLEQKGITIKPRYSFKRKEIRPGEFQTVDLDFPDTTESYKLYCQRAIASDIKECVSRAPDTPYDDSSYSNIPTTSYELPDGQIIEVGADRFKIPDIIFNPSLVQTIPGMESFAETAASLRGLPQMVIDSINKCDVDIRRELFSSILLAGGTASMQQLKERLEKDLLEESPQAARVKVLASGNATERRFSVWIGGSILASLGSFQQMWFSKSEYEEHGASYVQRKCP

SEQ ID NO: 269 - DNA, 909 bp, Triticum aestivum
atgtacggcggcgacgaggtctcggcgatcgtcatcgacgtgggctcctacagctgcaaggcgggctacgctggcgacgacacccccaaatgcgtcttcccctcggttgttggttcaattgaacaaacgggagatactgatgaagctaagccagaaaaggaggccgactctggatcagatcctaagaatggatccaagcctatggatgtggacaaagccaagacaaagcgcaaattttatctaggccaagaattagaattcaggagggatcatatggaggtgatctcaccgctgaaagatggaacagttattgattgggaagttgttgacaacatatggaaccatgcttttagacggcggctattgatcaatcctgaagagcatcctatgctgatagcagaaccatctacaaacagtggacagcaaagagagaaagcagccgaacttatgtttgagaagtacaaagtgccagcgctgttcctagcaaaaaatgcagttctcacatcttttgcatctggacgtgctacatctctggtggttgactgtggtggcgggtctactgtggtttctgctgtgcatgatggttatgttttgcaaaagtctgtggcaacttctccgattggcggtgaatttttgactgactgtatgatgaaaagcttggagagcaagggcgttgttatcaggccccgggattccttcaagaagaaggaagtgagccctggagattataaggttgtagaccttgattttccgaacaccacggatagttacaggttgtaccacatgagagctattgctagcgacatcaaggagacggtttgtagagttccagatactcccttcgatgaagtggcatatgcaaatgctcccacaacttcatacgagcttccagacgggcaaactatttga

SEQ ID NO: 270 - protein, 302 aa, Triticum aestivum
MYGGDEVSAIVIDVGSYSCKAGYAGDDTPKCVFPSVVGSIEQTGDTDEAKPEKEADSGSDPKNGSKPMDVDKAKTKRKFYLGQELEFRRDHMEVISPLKDGTVIDWEVVDNIWNHAFRRRLLINPEEHPMLIAEPSTNSGQQREKAAELMFEKYKVPALFLAKNAVLTSFASGRATSLVVDCGGGSTVVSAVHDGYVLQKSVATSPIGGEFLTDCMMKSLESKGVVIRPRDSFKKKEVSPGDYKVVDLDFPNTTDSYRLYHMRAIASDIKETVCRVPDTPFDEVAYANAPTTSYELPDGQTI

SEQ ID NO: 271 - DNA, 1332 bp, Zea mays
atgtacggcggagacgaggtttcggcaatcgtcatagatgtgggctcttacagctgcaaggcgggctacgcaggcgacgacacccccaaggccgtcttcccatcggttgttggttcaattgaacaaactgaagacacagatgaccccaagccagagaaggaagctgactctgcatcagattctaagaacggtgccaagcccatggatgtggacaaagccaagacaaaacgcagactttatgtaggccaagagttagagttcaggagggatcacatggaggtgatttcatctatgaaagatggaacggtaactgactgggatattgttgataatatatggaatcatgctttcagacggaggttgttgatcaatcctgaagagcatcctatgctcattgctgaaccatctacaaacactgcacagcaaagagagaaagcagcggaacttatgtttgagaactacaaagtgccagcgctgtttctagccaaaaatgcagtgctcacatcttttgcgtctggacgagctacatctttggtggttgacagtggtggtgggtctactgtggtttctgctgtacacgatggttttgttttacagaagtctgtgtcgacttctccagttggcggtgaatttttaactgactgtatgatgaaaagcttggagagcaagggcatcgtcattaggcccagatattcatttaagaagaaggaaatcagtcctggagaatataagattgtagatcttgatcttccaaacacaactgagagttacaggttgtactgcatgagagctattgctagtgacgtcaaggagtctgtttgcagagttccagacactgcttttgatgaagtggcatatgcaaatgttcctacaacttcatatgagcttcctgatggacaaactattgaagttggtgctgatagattcaaggttcctgatattctatttaatccatctctatcccagactattcctgggattgatggatttgcagattcaataccagtccgtggccttcaacgaatggtcattgatagcgtaaataagtgcgacgttgacatacgaaaagagctattcagtaacatcttgctctctggtgggtcatcatcaattctgcagttaaaggagcgcctggagaaagaagtattggaggagtctcctcaagctgctcgtgtcaaggttatggcaagcggaaactcagtagagagacgtttcagtgtttggattggagggagcattctagcatctcttgggtcgttccagcagatgtggttctccaaagcagagtatgaagagcatggggtttcctatattcagagaaagtgcccttga

SEQ ID NO: 272 - protein, 443 aa, Zea mays
MYGGDEVSAIVIDVGSYSCKAGYAGDDTPKAVFPSVVGSIEQTEDTDDPKPEKEADSASDSKNGAKPMDVDKAKTKRRLYVGQELEFRRDHMEVISSMKDGTVTDWDIVDNIWNHAFRRRLLINPEEHPMLIAEPSTNTAQQREKAAELMFENYKVPALFLAKNAVLTSFASGRATSLVVDSGGGSTVVSAVHDGFVLQKSVSTSPVGGEFLTDCMMKSLESKGIVIRPRYSFKKKEISPGEYKIVDLDLPNTTESYRLYCMRAIASDVKESVCRVPDTAFDEVAYANVPTTSYELPDGQTIEVGADRFKVPDILFNPSLSQTIPGIDGFADSIPVRGLQRMVIDSVNKCDVDIRKELFSNILLSGGSSSILQLKERLEKEVLEESPQAARVKVMASGNSVERRFSVWIGGSILASLGSFQQMWFSKAEYEEHGVSYIQRKCP

SEQ ID NO: 273 - DNA, 1722 bp, Glycine max
atgggcgaggtatctgaaagtaccatgacgaagaggaagaagaagggacgcccctctcttttggatcttcaaaagcgatctctcaaaaaagaacagcaaaatcaccaccagcagcgacacaattcaaccaacgttgttccccacgacgacgacgaggacgagcgcaaggagaagaagcacaagctcttggttggtctcaattcccatctccaccacccaacattattgcccaattcccaacccttcaattccgatcccaagaggcgcaagattattgaccctctccaaacggatgtgaaggttccgaaagcgactgacagtaaacaacatggttcgcagggagagtccggtcccactacgcctttgccagacaaaaagctcttgctgtttatccttgacaggcttcaaaaaaaggacacacatggggtgttctctgagccagtggatccagaagagcttcctgattatcttgacatcattaaacacccgatggattttggaactgtcaggaagaaattggatggggggctatatactgacttggaacattttgagaaagacgtgttcttgatatgctctaatgcaatgcaatataattcctcagataccatttaccatcgacaggcccgagccatgcaagagattgcaaggaaagactttgagaatcttagacaagatagtgatgatgatagtgaaccacagcccaaaattgtgcagagaggaaggccaccaggcaagcactcaagaaagtcactgggactgggtatgcctcctcctgagcgtgttggtcctgaatcttcttctgatgcaactctggcttctggcggggatattgctagtggttccaacggttataatctaagaaaagtacccagcaaatttcagcccacagattcatctgcgagggcctacaacagcacttttaacagtggagggtatgttggctggtctgaatgggagaatgaatttccagcttctgttgtaaaagctgtgctaagatatggaaagaagcagtttgtggttgatgaaaccaggcgtgatacttacaaaaatccagtgactttaggaaatgaacgaccggtgttgtccacagttgaagatgaattcaagcaacttcttgcagtaggtgtacacatgaagcatagctatgcaagaagtctagcccattttgctgcagaccttggtcctgttgtttggaagattgctgcaagtaaaatcagcagtgttttgccagcaggacatgattttggtcctggatgggtaagtgaagatgatggttcgtcacagaggcgacacttcccagtttgtgatgagggtagaacttcagaccctcctgtaccagaggattatagaagtagattttcttctccatctggatcgctcccccttgcaaatagaccattctatcaaagtggagacatggctatagataattaccaaaatgagttgaatccagtaatcaacattcctggtgggtctgaatccataactcctatgaggattcagcaggaatccatggtgcactctgatgattttggttcatgtgatcggttaggttctaatttcccatctcaaatgaagatgggattggaagttcccactaaacagaattcttttgctcttgctaatgacttaaatggaaggattggaactacaaactcacccagttccaacgtggaggctggttcccagttgcagcctaatttggcattacagctctga

SEQ ID NO: 274 - protein, 573 aa, Glycine max
MGEVSESTMTKRKKKGRPSLLDLQKRSLKKEQQNHHQQRHNSTNVVPHDDDEDERKEKKHKLLVGLNSHLHHPTLLPNSQPFNSDPKRRKIIDPLQTDVKVPKATDSKQHGSQGESGPTTPLPDKKLLLFILDRLQKKDTHGVFSEPVDPEELPDYLDIIKHPMDFGTVRKKLDGGLYTDLEHFEKDVFLICSNAMQYNSSDTIYHRQARAMQEIARKDFENLRQDSDDDSEPQPKIVQRGRPPGKHSRKSLGLGMPPPERVGPESSSDATLASGGDIASGSNGYNLRKVPSKFQPTDSSARAYNSTFNSGGYVGWSEWENEFPASVVKAVLRYGKKQFVVDETRRDTYKNPVTLGNERPVLSTVEDEFKQLLAVGVHMKHSYARSLAHFAADLGPVVWKIAASKISSVLPAGHDFGPGWVSEDDGSSQRRHFPVCDEGRTSDPPVPEDYRSRFSSPSGSLPLANRPFYQSGDMAIDNYQNELNPVINIPGGSESITPMRIQQESMVHSDDFGSCDRLGSNFPSQMKMGLEVPTKQNSFALANDLNGRIGTTNSPSSNVEAGSQLQPNLALQL

SEQ ID NO: 275 - DNA, 1704 bp, Oryza sativa
atgggcaagcagcagccgcagccgccaccggcggcgatgtcggcgccaccgcggaagcggaagaagaaggggcggccctccctcctcgacctccagaagcggaccctccgcctcgagaagctgcaggagccgccgccgccgccaccgcccccgcagccgcggcggtccacgcggaggaaccccgccggcgtcgactccggcgacgaggggacggcacccggcggccgccgcgagaagaagctccgcctcgtcatgggcctccccgacggatcggccaagggagaaaagacgaggaaagcgacggatgggagtgaagagccgtcagattccgggcccacgacacctttgccggacaaaaagttgttagtcttcgtccttgataggctgcagaagaaggacacatatggtgtattctctgaccctgttgaccccgaagagctgcctgattaccatgatattatcaagcatccaatggatttttcaacaattcggaagaagctcaataaaggggcttatggcaacttggagcaatttgaggatgatgtattcttgttaacctcaaatgcgatgtgctacaattcaccagatacaatatactatcgacaggcacgggcgatccaagagcttgccaagaaggactttgagaaccttaggcaggatagtgatgcaagtgagccagaaccagaaccggaaattaaaccagatcctgaaccaaagccacaaccacggaggggcaggcctccaaataagaacactatcaaacagaaagttgggaagccaccggtagaacgcgctactgcagacttttctggagcaacactcgctagtgttggaaataatggacatcgtacgcagccaccatttgatctgcaacggcaagtaatgaatggatcctttatcgcagatgtactgagagcttcttttgccagtcgaaataatggatacaattggtctaacgagcgcaaattggaaagaattgaagattactcagggtctatcggtaaatggtcagcaaaaagtgggagaaaaccaattctgacagaagaaagtagccgaagcacttattgtcagcctcaaccttcgagttcaatatatgagctgccggtgtcgtcctcatacaacgagacaaggaagctgctagttccagttggggttcagttgcagcagtcctatccccgcagcttggcacgttttgctgcgcagctaggtcctgtcgcttgggagattgcgtccaaacgaattgaacgtgcccttcccccaggaacaaagtttggccgtgggtgggtaggagacggtgaagcaccgaacgcaactcagccaccagtgcttactacatcttcaacagccttgatacacccaagtagtacagaaacatcaagtgaacagccaactcataacggtacggccagcacaagccattcagcaggacctcagccatcttccgcaccatatgcctcttctacaatcacaactcatagggtcaattgtcagtcattaccaagccagcaacacggatcagtgccacaggtttcagcagaaagaggtgaacatggtgctgaggtgaagggcaaccataataatcttcatgaacggccagccattcagcacactgttaatggcttcagtgctgtttcaggatcaaacatattcccttctgcggcacagatggtggcgaatcggatgcagacacatacagctgattag

SEQ ID NO: 276 - protein, 567 aa, Oryza sativa
MGKQQPQPPPAAMSAPPRKRKKKGRPSLLDLQKRTLRLEKLQEPPPPPPPPQPRRSTRRNPAGVDSGDEGTAPGGRREKKLRLVMGLPDGSAKGEKTRKATDGSEEPSDSGPTTPLPDKKLLVFVLDRLQKKDTYGVFSDPVDPEELPDYHDIIKHPMDFSTIRKKLNKGAYGNLEQFEDDVFLLTSNAMCYNSPDTIYYRQARAIQELAKKDFENLRQDSDASEPEPEPEIKPDPEPKPQPRRGRPPNKNTIKQKVGKPPVERATADFSGATLASVGNNGHRTQPPFDLQRQVMNGSFIADVLRASFASRNNGYNWSNERKLERIEDYSGSIGKWSAKSGRKPILTEESSRSTYCQPQPSSSIYELPVSSSYNETRKLLVPVGVQLQQSYPRSLARFAAQLGPVAWEIASKRIERALPPGTKFGRGWVGDGEAPNATQPPVLTTSSTALIHPSSTETSSEQPTHNGTASTSHSAGPQPSSAPYASSTITTHRVNCQSLPSQQHGSVPQVSAERGEHGAEVKGNHNNLHERPAIQHTVNGFSAVSGSNIFPSAAQMVANRMQTHTAD

SEQ ID NO: 277 - DNA, 1719 bp, Physcomitrella patens
atggcggagaaggacaagaaactgaaggtgattcttaaactgccaaagaaatcaagcagccgtagcaaggcgggggtccctggtgcactatcatcacccggaggaatatctcataaaataaattcctcgccagtcgtagagagtgagacgccgttgaagccgagttctaagttgtctgttcccaacgctaatgctaatagtcgtgttgccacccctcctaagaaacgcaagttcaagactttagttgaaggggacgccaaggatgatctaggaggcgcatgtggtgtctcaagtactactgaaattctccccgtcttcaaggctcccttgccccctttcgctaagaagccttctcataagaaaaaagagaggccgattaatggcgcaattgaagctccttttccaagtctaggaaaaggacaaggcccctcaccagcgcctgctaagaaggtgcttgaaggtgtgttagacaagctgaaaaaaaaagacacatatggagtattttcggagcctgtggatgcaaacttggttccagattactatgatgtcatcaaagagcctatggacttcggcacgatgtacaagaagatctcaaaggggctgtataacatattaagtctatttgagaaagatatcatgctcatttgcaacaatgctatgcgatacaatggcccagaaacagtatactataagcaggcacgctcaatacaagatgctgcccgtaaggcattggatgtgatagctagtcaagctgggtctgctgaagctggaaccgccaagcctgctgcgcacaaaaagcaggctcatccatcaaagaaaacatggtccaacccagcagctccgaagacaacattggaacctgcgaattccgactttgcttctggggccagtttagcagcagagggagaagctcagtcaaataaacacgatttcgtcacttccaaaagagggacacagtcggatagatctggaagtgttgctggagaggagccaggatatggggttcagtcacaggcaactgccgcctttgagccagacgcagatgtgcaagatgaacaaggggctcaacagaaaccagtagctcttaaggatgggcgaaggccttcgtcaacagaagagtatcacagaagcacttacaagccacggaacctttctgctcatggaagaggacctacttttgctggtgttggtggtgaattgcatcaccttgtaccaacagggtatcagtcagagatggcgtatgcaaagagcttgtctcgattttcagctaaactgggacctgagggatggaaattcgcagctcaaagattgcagagagtattagcaccctctgtaccttttgggcaaggatggataggtgtgcatgaagctcccccaggcacgattttcagaaagtttccttcggatgtaaaagttacaaatgcaacgaggaccaatcaaaatttgagctccacagcttcacctaaccttctgggaggtccatcctcttcttaccctccagttacttctgcttacgtgcctagccctaaatcatctcgcccattgacgataaatcccgcagcccaaactgcaatggattctttgccgactaaggttaccagtgccatgcttgtatcaggagcagcaagtcaaggaatatttccaggaaagttaacaatggaatcagttgttgagaaaccttcccagccagtttatcagctggagcgcagcagaagttga

SEQ ID NO: 278 - protein, 572 aa, Physcomitrella patens
MAEKDKKLKVILKLPKKSSSRSKAGVPGALSSPGGISHKINSSPVVESETPLKPSSKLSVPNANANSRVATPPKKRKFKTLVEGDAKDDLGGACGVSSTTEILPVFKAPLPPFAKKPSHKKKERPINGAIEAPFPSLGKGQGPSPAPAKKVLEGVLDKLKKKDTYGVFSEPVDANLVPDYYDVIKEPMDFGTMYKKISKGLYNILSLFEKDIMLICNNAMRYNGPETVYYKQARSIQDAARKALDVIASQAGSAEAGTAKPAAHKKQAHPSKKTWSNPAAPKTTLEPANSDFASGASLAAEGEAQSNKHDFVTSKRGTQSDRSGSVAGEEPGYGVQSQATAAFEPDADVQDEQGAQQKPVALKDGRRPSSTEEYHRSTYKPRNLSAHGRGPTFAGVGGELHHLVPTGYQSEMAYAKSLSRFSAKLGPEGWKFAAQRLQRVLAPSVPFGQGWIGVHEAPPGTIFRKFPSDVKVTNATRTNQNLSSTASPNLLGGPSSSYPPVTSAYVPSPKSSRPLTINPAAQTAMDSLPTKVTSAMLVSGAASQGIFPGKLTMESVVEKPSQPVYQLERSRS

SEQ ID NO: 279 - DNA, 2079 bp, Populus trichocarpa
atgggcgaggaagcagacccaacaatgaagaagaagaagaaaaagggacgtccttctcttctagagcttcaaaaacgctccctcaaacaacaacagctacagcaaacaacccctatttctcttaaaaaccctaatcctctcaattccaattctgccctccctaaccgtcgatccgctcgccggagctctaattcctatgcaccggagtggattgacggagacgacgacgaagacgacgacgaagacgatgagcgtaaagagaagaagcataagctcttgcgcggattgaattctcagaaaaataacaatcagaattccaattcgtcgagcccttcgaatttgcacggctctgattcgaatgctggtggcggtaatcaagaggacggaattagaaggcgcaagatcagcgccgtccgtcttggatctgatgatttgggtgaaaaggttttgaaagggacagacactattcatgggtcatctgtggagcctggtcccactacacctttgccagacaaaaagttgttggtcttcattcttgacagacttcaaaagaaggacacctatggggttttctctgagccagtggatccagaagagcttcctgattactttgacatcgttgagaatcccatggatttttctacagtgaggaaaaagttagatgagggagcctacgcccacttggaacaatttgagaaagatgttcttttgatatgctcaaatgcaatgcagtacaacccttccgatactatttacttccgacaggcaagggccatgcaagagcttgcaaagaaggactttgagaatcttaggcaagatagtgatgatagtgaaccacaaactaaggttgcgaggagagggaggccaccagccctaggcaagctgaaaaaggcacttgagaggtctccaattgaccgtgttggtcctgaagcttcctcggatgcaactcttgccaccggaggagatcacaataacttgtccaatggttacaatctcagaaaaagttcttcatacaagtaccagcctggtgatgcatttgtccgggcctcttacagcagtgaaaattattctacctggttatctgaatgggaaaatgaatttccagcatctgttgtaaaggctgtgatgaagtatggaaagaaaccgtttgtgctagatgagaacaagcgtgacacctataagcatccattgggctcccatgagccatccatcttatcgacctttgaaggagaattaaagcaattagtggtggtaggtttaagctctgagcacggttatgcaagaagtctggctcgatttgctgctgatcttggccctgttgtttggagaattgcttcgaagaaaattgaaagtgttttgccaacaggacttgagtttggccctgggtgggtaggagaaaataaagcaatggagaagcaaaagattttaaacaaccttgtatctgataaccatttaagcagatttcaacctgctgcttcttcaagtagagaggcagcatggaatagagaaggcctgccagaaactgttggcgggttaaatcctcaaaatgagttagctacactgaacagtggtgctggtgggatgaaatccatgccttctctccagattcagcagaaaccaataattcatcctgatatgaatggtttcagtggaggatttggatataactcttcacctcaaccggggatggcacgaactgtggcaccgacaggaaagctcaatttggagcagactgcagtgccttcccaaatgtttggtgtggttccaactggcaacagtgccttcatttcagtgcctgggaatgattttaatacaaataaaggtatgctgtcagaaacttcaagtggattattgcagcctggaatttctccagccgtaggctccagctctgactctcgtacatttggcaatgtggggtttggtggcaaatcatcttggcagggatttttaccatatcagcaacaaggtactgttccatttccaccagatctgaatgttggattcttggcacctggttcacctacttcgagtgtgcccatcggttcaccacggcagccagatttagcattgcagctctga

SEQ ID NO: 280 - protein, 692 aa, Populus trichocarpa
MGEEADPTMKKKKKKGRPSLLELQKRSLKQQQLQQTTPISLKNPNPLNSNSALPNRRSARRSSNSYAPEWIDGDDDEDDDEDDERKEKKHKLLRGLNSQKNNNQNSNSSSPSNLHGSDSNAGGGNQEDGIRRRKISAVRLGSDDLGEKVLKGTDTIHGSSVEPGPTTPLPDKKLLVFILDRLQKKDTYGVFSEPVDPEELPDYFDIVENPMDFSTVRKKLDEGAYAHLEQFEKDVLLICSNAMQYNPSDTIYFRQARAMQELAKKDFENLRQDSDDSEPQTKVARRGRPPALGKLKKALERSPIDRVGPEASSDATLATGGDHNNLSNGYNLRKSSSYKYQPGDAFVRASYSSENYSTWLSEWENEFPASVVKAVMKYGKKPFVLDENKRDTYKHPLGSHEPSILSTFEGELKQLVVVGLSSEHGYARSLARFAADLGPVVWRIASKKIESVLPTGLEFGPGWVGENKAMEKQKILNNLVSDNHLSRFQPAASSSREAAWNREGLPETVGGLNPQNELATLNSGAGGMKSMPSLQIQQKPIIHPDMNGFSGGFGYNSSPQPGMARTVAPTGKLNLEQTAVPSQMFGVVPTGNSAFISVPGNDFNTNKGMLSETSSGLLQPGISPAVGSSSDSRTFGNVGFGGKSSWQGFLPYQQQGTVPFPPDLNVGFLAPGSPTSSVPIGSPRQPDLALQL

SEQ ID NO: 281 - DNA, 2355 bp, Oryza sativa
atgccgcggaaggcctcgtcgacctcagattcgcgcctgaaatggcggaagtggaagcggaaccccaccgcgtccccgtcgccgtccaaccgctcgtcggccgccgccgccgcggcggaccactccgacgactccgactccgccgccgttaacgaggacgacgactccgcggtccccgaggacgccgacgacgaaaccctagccggggcggaggaccccgtgctcgacctccgcgaggcggaggtgctcccttcggcggagcccgtctcggcgttccccgtcgccacccgacgcgtcgtcaaccggccgcacccgtccgtcctcgccgtcatcgcggccgagcgatccgcgtgcgcgggtgagggttccgccgcggtggcggcggcgccggtgctggagaacatctcgtacgggcagcagcaggtgctctccggggtgctccctgaccacgcttcgctcgcgacggacactgacaagccgtctacctatgtgtgcacgccgccgaatcttatggaggggcatggcgtgaccaagcagttccagggtcgcctacatgtcgtgcccaagcactcagattggttctccccagggatcgtgcacaggctggaaaggcaggtggtgccacagttcttttcagggaagtcgccgggcaacactccagagaagtacatgctattgaggaataaggttattgcaaaatatttagagaacccaagcaagaggcttgcttttgcagagtgccaggggcttgttgcgaacacagctgaattatatgatctcagtaggattgttaggttcttagacacttggggaatcatcaattaccttgcgtctgggtcggtgcaccggggtctaaggatggcaacctcccttctaagggaggagccaaccggggagttgcaactattgactgcgccactgaaatcaattgatggcctaattttgtttgatcgaccgaaatgtaacctccaagcagaggacatttcttcattggcatcaaattcggaggttgtggattttgatgctggacttgcagaattggatggaaagattagggagcgattgtcagagagttcttgcagttattgcttacagcctttgaccagcttgcactatcagtcactaaaggaggcagatatcgctctatgctctgattgcttccatgatgcgagatatattactgggcattcaagcttagattttcagaggattgatggggataacgatagatcagaaaatgatggggatagttggactgatcaagaaacgttattgctgttggagggcatagagaagtacaatgacaactggaataacattgcagagcatgttggaacaaagtcaaaagcacaatgtatttaccattttattcgtcttcctgttgaagatggtttgttagagaatattgaggtgccagatgcatctgtgccatttagagcagaaaccaatggatacccacatttagattgcaatggcagtacttcaggaaatctacctcaaaaaattccacctgataaccagcttccgttcattaattcttctaatccggtgatgtcactggttgggtttttggcttctgctatgggaccaagagttgcagcatcatgtgcaagtgctgctttatcagttttgacagtagatgatgattccagggtgaattcagaaggcatttgctctgattctaggggccaaggtccgcatccgaattttcgtgatcataatggtggtgtatcttcatccatctctccagaaaaggtgaagcatgctgccatgtgtggtttgtcggcagcagctacgaaggctaaactttttgcagatcaagaggaacgtgaaatccaaagactaactgctactgtaataaaccatcagttaaaaaggttggaactgaagctgaagcagtttgccgaagtcgagaccttgcttttgaaagaatgcgagcaagtggagagaataaggcagaggattgcatctgaccgtgtccgaatcgtgtccacccgcttggcctcgcctggaaatagcctacctgggggtagtactagcaccatgtcatccaatccaatgagtatgagccccagaccgatgggcgtgccaggctcgatgcctcaatccagtatgccagcaccatttgccaataacatgcaggggcatggtcacccccagatggcattcttacaacagcagcagcggcagcagatgctgtcatttggacctcgtctgccgctgtcggccatccaaacccagccatccccacagacgtcaaacatcatgttcaacccaggcatgcccaattctgtaacccctaatcatcatcaactgttgaggtcgtcttctggaaacaattcaagtgtaggatag

SEQ ID NO: 282 - protein, 784 aa, Oryza sativa
MPRKASSTSDSRLKWRKWKRNPTASPSPSNRSSAAAAAADHSDDSDSAAVNEDDDSAVPEDADDETLAGAEDPVLDLREAEVLPSAEPVSAFPVATRRVVNRPHPSVLAVIAAERSACAGEGSAAVAAAPVLENISYGQQQVLSGVLPDHASLATDTDKPSTYVCTPPNLMEGHGVTKQFQGRLHVVPKHSDWFSPGIVHRLERQVVPQFFSGKSPGNTPEKYMLLRNKVIAKYLENPSKRLAFAECQGLVANTAELYDLSRIVRFLDTWGIINYLASGSVHRGLRMATSLLREEPTGELQLLTAPLKSIDGLILFDRPKCNLQAEDISSLASNSEVVDFDAGLAELDGKIRERLSESSCSYCLQPLTSLHYQSLKEADIALCSDCFHDARYITGHSSLDFQRIDGDNDRSENDGDSWTDQETLLLLEGIEKYNDNWNNIAEHVGTKSKAQCIYHFIRLPVEDGLLENIEVPDASVPFRAETNGYPHLDCNGSTSGNLPQKIPPDNQLPFINSSNPVMSLVGFLASAMGPRVAASCASAALSVLTVDDDSRVNSEGICSDSRGQGPHPNFRDHNGGVSSSISPEKVKHAAMCGLSAAATKAKLFADQEEREIQRLTATVINHQLKRLELKLKQFAEVETLLLKECEQVERIRQRIASDRVRIVSTRLASPGNSLPGGSTSTMSSNPMSMSPRPMGVPGSMPQSSMPAPFANNMQGHGHPQMAFLQQQQRQQMLSFGPRLPLSAIQTQPSPQTSNIMFNPGMPNSVTPNHHQLLRSSSGNNSSVG

SEQ ID NO: 283 - DNA, 2391 bp, Populus trichocarpa
atgccagcttctccttctttcccttcctcagatggtaggggcaaatggaaaaggcgaaagcgaggagattctcaaattacacgaaaacctccaaagcaccaccaccaagaagaaacagaagaacccgaagaagaagacgacgccgttgatgcagacgaaaataataacaacgtcatcgacagagaagattctgatgacccgaacccaaatcaacagcccagcggacccgatccaaaccctcaagagaccgaggttttaattgacggtggggtccgcttatgcgatttccctcctgtcacgaggctcgctgtgaaccgccctcatgcctccgtgatggcgattgtggcggccgagagggcctgcttggctggggaaagcagtaatagagggcaattggtggttagtttggagaatgtatcgtacgggcagctgcaggcggtgtctgctgtgatagcggactgtgatgggagtgatttggagaggagtgatggagggaatacagggtatgtagtgacgccgccgcagattatggatggaaagggtgtcgtgaagaggttttggagcagagttcatttggttcctatgcattcagattggttttctccggccttggtaaatcgactggagagacaagtggtgccacattttttctctggaaaatctccagatcacacaccagagaaatacagggagtgtagaaatcgcattgttgctaaatacatggagaatccagagaagaggctcacagttcctgattgtcaaggattggtagtcggcattgacaatgaagattttactcgaatttttagatttcttgatcattggggaattataaactactgtgcagctccaccaagttgtgaatattggaatggggggtcttatttaagggaggatccaaatggtgaggttcatgtgccatcagctgctttaaagtcttttgatagtttgatccaatttgacaagcccaaatgtaggctcaaggcagctgatgtttactcatcattgtcatgtcatgatgatgatctctctgacttggacaacagaattcgagagtgcttatctgaaaatcgttgcaatcattgttctcagcttcttccctctgtgtgctaccagtcacaaaaggaggttgatatactattatgccctgactgctttcatgaggggagatttgtgactggtcattcaagcttagattttattaaggtggattcaacaaaagattatggagatatagatggggaaagttggagtgatcaggaaacattactgctacttgaggcaatggaaatttacaatgagaattggaatgaaattgcagagcatgttggctccaagtcaaaagcacaatgcatccttcattttctccgtctgcctgtggaggatggcctgttggaaaacattgaagttcctagcatgcccaagtcaatcagcccatcaaatagagaggataacagaagaccacactcaagttcaaatggatcctgcctccaaggtgctgatgctgaaaacaggctcccttttgcaaattctggcaatccagttatggcattggttgcttttctggcctctgctgttggaccaagagttgctgcagcctgtgctcatgcatctttggaagcgctgtctgcagataataggttgggttcagagagactacatggtagagaaggtggttttcatggagaagttgcaaattcaattcaactagaagaagatagccaacatggctcacggggtcaaaatggggctgaggttgctcctccgtctgctgaaaaagttaaagctgctgccaaagctggccttgctgctgcagcaacaaaagctaaactgtttgccgatcatgaagaacgagaaattcagaggctatctgctaatataataaatcatcagttgaagagattggagcttaagctgaagcaatttgcagaagtggaaacctttctaatgagagagtgcgagcaagtggagaagacaaggcagaggtttgctgctgagcgaatccgcatgctatctacccggataacacctgcaggagttgcttcacaaatgaaccaagcaggtgttgctccttcgatggttaacaataatgttggcaacagtaggcagcaggtgatgccttcctcttcttcgcaaccaagcatttcaggatatggcagcagtaacccagcccatccacacaacaatcaacaagtccattctcacatgtcatatatgcaacggggacagccacaaccaatgtttccattagggccgaggctgcccgtggcagctatacagccatcatcgccagctccgtcaagtgtcatgtacaatgcctctggaaattcacagcctaacctcaatcaaatgctgcggtccgtgtcaggccctagctctggtttaggttga

SEQ ID NO: 284 - protein, 796 aa, Populus trichocarpa
MPASPSFPSSDGRGKWKRRKRGDSQITRKPPKHHHQEETEEPEEEDDAVDADENNNNVIDREDSDDPNPNQQPSGPDPNPQETEVLIDGGVRLCDFPPVTRLAVNRPHASVMAIVAAERACLAGESSNRGQLVVSLENVSYGQLQAVSAVIADCDGSDLERSDGGNTGYVVTPPQIMDGKGVVKRFWSRVHLVPMHSDWFSPALVNRLERQVVPHFFSGKSPDHTPEKYRECRNRIVAKYMENPEKRLTVPDCQGLVVGIDNEDFTRIFRFLDHWGIINYCAAPPSCEYWNGGSYLREDPNGEVHVPSAALKSFDSLIQFDKPKCRLKAADVYSSLSCHDDDLSDLDNRIRECLSENRCNHCSQLLPSVCYQSQKEVDILLCPDCFHEGRFVTGHSSLDFIKVDSTKDYGDIDGESWSDQETLLLLEAMEIYNENWNEIAEHVGSKSKAQCILHFLRLPVEDGLLENIEVPSMPKSISPSNREDNRRPHSSSNGSCLQGADAENRLPFANSGNPVMALVAFLASAVGPRVAAACAHASLEALSADNRLGSERLHGREGGFHGEVANSIQLEEDSQHGSRGQNGAEVAPPSAEKVKAAAKAGLAAAATKAKLFADHEEREIQRLSANIINHQLKRLELKLKQFAEVETFLMRECEQVEKTRQRFAAERIRMLSTRITPAGVASQMNQAGVAPSMVNNNVGNSRQQVMPSSSSQPSISGYGSSNPAHPHNNQQVHSHMSYMQRGQPQPMFPLGPRLPVAAIQPSSPAPSSVMYNASGNSQPNLNQMLRSVSGPSSGLG

SEQ ID NO: 285 - DNA, 2619 bp, Brassica napus
atgaattcaattttttccggtactcgtctaagggacatgatccgatccataagagcgtgcaaaacagctgcggaggagcgtggcgttgtgaggaaagagtgtgctgatatcagagcgtccattaatgaaaatgaccctcatgataggcaccggaacctcgccaagctcatgttcatacacatgctgggttaccctacgcattttggtcagatggagtgcttgaagcttattgcgtctcctggcttcccagagaagaggattggttatctcgggctgatgttgcttcttgatgagagacaggaagtgttgatgctcgtcacaaattcattaaaacaagatcttaaccacacgaaccagtatgttgtagggcttgcgctctgtgctttagggaatatttgctctgcagaaatggctcgtgatcttgcgcctgaagtagaaagattgatccagtttcgtgaccctaatatccgtaagaaggcggcactttgctccactagaatagtaaggaaggttccagatcttgcagagaactttataaatgctgcttcttccttgcttaaagaaaagcatcatggggttcttataacaggagttcagctttgttatgaactatgcacgatcaatgatgaagccctagaatacttccgaaagaaatgcacggaggggctgataaaaactttgagggatattacaaatagcgcatatcagcctgagtatgatgttgcagggatcacagatccttttcttcacatacggttacttaagctcctgcgtgttttaggccatggtgacgctgatgctagcgatttgatgactgacatacttgcccaggtggccacaaaaactgaatcaaacaaaaacgcaggaaatgccgtactctatgagtgtgttgaaacaatcatggccattgaagacaccagtagcttgcgtgtgcttgctatcaatatcttgggaagattcttatctaaccgcgacaacaatatcagatatgttgcattaaacatgctgatgaaagcaatcgcgtttgatgatcaagcagtgcaaaggcacagagttacaatcttagaatgtgttaaggacccagatgcttccatccggaaaagagctcttgagctcgtttctcttttggtaaatgagaacaatgtcaaacaactgacaaaggagctgattgattatttggaaatcagcgatgaagattttaaggaggatcttagtgcgaaaatctgttccattgttgaaaagttttctctagagaaaatctggtacattgatcagatgctcaaggttctgtcggaggctggaaagtttgtgaaagatgatgtgtggcatgcactgattgttgtcataagcaatgcatcagagcttcatggatatacagtcagagcattatacaaagcagtcctgacatattcggaacaggagacccttgtccgagtggcgatttggtgcattggggaatatggtgatttgctggttaacaatgtggggatgcttggtattgaagatccaataacggtaacggaaagtgatgcagttgacgttgtcgaggatgccattactcgccataactcagatatgactactaaagctatggcattggttgctctgctgaagctgtcatcccgctttccttctatctcagagaggattaaagatataattgtgaagcagaaagggagccttctccttgaaatgcagcagagagctattgaattcaattctattgttgacaggcataaaaatatcaggtcttctctggttgagagaatgccggtgctagatgaggctaccttcaatgtgaggagggctggctctttgcctgcgtcagtttcaacaatggccaaaccttcagttagtattccaaatggtgttgctgcagctccactagtggatttattggacttgggttctgacgatatcatggctgcacctagttcatctggtgcagatttccttcaggatcttcttggtgttgacttaggatcatcgtcagtacaatctggtgcatccccgggtccaaaagccggtgcagatctgttgatggatattttatcaattgggacaccttctccggcacaaaacaacacatcatcagttgatttgttatcaacagctggcattaacaacaatccttctaatgcgctagacacactttcttcaccagctctacctcacatagcaacgactgcttctgctggtggtatgttcgatttgttagatggtcttactcctagcccatcgaaggaagcaaccaatggtccagcatatccacctattgttgcatacgagagcagcaccttgaagattgagttcacattctcaaagtcatcagggaacccacaagaaacaaatgtccaggccacttttataaatctatctcctaatactttcacatattttatcttccaggctgctgttccaaagttcctccagctgcacttggatccagcaagcagtaacacactcccggcaagcggtaacatcacgcagaatctgagagtcacaaacagccagcacggcaagaaatctcttgtgatgcgcatgaggattgggtacaaagtgaacggaaaagatgtattggaggaaggacagatcaacaacttccctcgtgggttgtga

SEQ ID NO: 286 - protein, 872 aa, Brassica napus
MNSIFSGTRLRDMIRSIRACKTAAEERGVVRKECADIRASINENDPHDRHRNLAKLMFIHMLGYPTHFGQMECLKLIASPGFPEKRIGYLGLMLLLDERQEVLMLVTNSLKQDLNHTNQYVVGLALCALGNICSAEMARDLAPEVERLIQFRDPNIRKKAALCSTRIVRKVPDLAENFINAASSLLKEKHHGVLITGVQLCYELCTINDEALEYFRKKCTEGLIKTLRDITNSAYQPEYDVAGITDPFLHIRLLKLLRVLGHGDADASDLMTDILAQVATKTESNKNAGNAVLYECVETIMAIEDTSSLRVLAINILGRFLSNRDNNIRYVALNMLMKAIAFDDQAVQRHRVTILECVKDPDASIRKRALELVSLLVNENNVKQLTKELIDYLEISDEDFKEDLSAKICSIVEKFSLEKIWYIDQMLKVLSEAGKFVKDDVWHALIVVISNASELHGYTVRALYKAVLTYSEQETLVRVAIWCIGEYGDLLVNNVGMLGIEDPITVTESDAVDVVEDAITRHNSDMTTKAMALVALLKLSSRFPSISERIKDIIVKQKGSLLLEMQQRAIEFNSIVDRHKNIRSSLVERMPVLDEATFNVRRAGSLPASVSTMAKPSVSIPNGVAAAPLVDLLDLGSDDIMAAPSSSGADFLQDLLGVDLGSSSVQSGASPGPKAGADLLMDILSIGTPSPAQNNTSSVDLLSTAGINNNPSNALDTLSSPALPHIATTASAGGMFDLLDGLTPSPSKEATNGPAYPPIVAYESSTLKIEFTFSKSSGNPQETNVQATFINLSPNTFTYFIFQAAVPKFLQLHLDPASSNTLPASGNITQNLRVTNSQHGKKSLVMRMRIGYKVNGKDVLEEGQINNFPRGL

SEQ ID NO: 287 - DNA, 2616 bp, Glycine max
atgaacccgttctcttcaggaacgcgtttgagggacatgattcgggccatacgtgcttgtaagactgcagcagaagaacgagctgttgtaagaaaagaatgtgctgccattcgtgctgcaataaatgaaaatgataatgactataggcatcggaacctggctaagctaatgttcatccacatgcttggttaccccacacattttggtcaaatggaatgcctcaagttgatagcatctcctggatttccagagaagagaataggttatcttggcctcatgttgcttcttgatgaaagacaagaagttctaatgttggtcaccaattctttgaaacaagatcttaatcacacaaatcagtatatagtgggacttgctctttgtgctttaggaaacatttgttcagcagaaatggctcgtgatcttgcaccagaggttgagagattgcttcaatttcgagatccaaatattcggaagaaggcagcattatgctctataaggatcataaagaaagttcccgacttggcagaaaattttatcaaccctgctacttccttactcagggagaagcatcatggggttctgatcactggggttcagctttgtacagatctgtgtaaaattagcactgaagctcttgaacatattaggaagaaatgcacagatggtttggtcagaactcttaaggatctagccaatagtccatattcaccagagtatgatattgccggtatcacagacccatttctccacatcagattgcttaaacttttgcgagtgttgggtgaaggcaatgctgatgctagtgacaccatgaatgacatacttgcccaggtggctacaaagactgagtcaaataaagttgcagggaatgccattttatatgaatgtgttcaaacaataatgagcattgaagataatggtggcttacgtgtacttgccattaatatcctgggaagatttttgtcaaatcgtgacaacaatatcagatatgtggcattaaacatgctaatgaaggctgtaactgctgatgctcaggcagtacagaggcaccgtgcaacaattatagaatgtgtgaaggattcagatgcttcgattcagaaaagagcccttgaacttgtttatgttttggtgaatgaaactaatgtgaagcccttggcaaaagagcttatagattatctggaagtcagtgatcttgatttcagaggggaccttactgccaaaatttgctccattgtagcaaagtattccccagagaagatctggtatattgatcagatgctcaaggttctgtctcaggctggaaattttgtaaaagatgaagtatggtatgccttaattgttgtgataaccaatgcttctgagcttcatggatatacagtaagagcattatacagagcatttcaaatgtcagctgaacaggagactctagttcgagttacagtgtggtgcattggggagtatggtgacatgttagttaataatgttggaatgcttgacatagaagatccaataacagtgactgagttcgatgcagttgatgtcgtagagattgctataaaacgccatgcatcagatcttaccacaaaatcgatggctttggttgcactattaaagctctcttcacgtttcccttcatgttcagagaggatcaaagaaattattgttcagttcaaagggagctttgtgctagaattgcagcagagagctattgaattcaattcgattattgcaaagcatcaaaatattaggtctacacttgtagaaaggatgccagttttggatgaggcaacttccattggtaggagggctgggtctctaccaggtgcagcttcaactccaactgcaccttcatttaatcttccaaatggaacagccaaacctgtggctcctcttgtagatctacttgatctaagttcagatgatgctcctgcacctagctcttctagtggaggagatattcttcaggaccttcttggtgttgatctttcaccagcatcacaacaatctgttgctggccaagcttcaaaaagtggcaacgatgttcttttggatcttttgtctattggatcaccttctgtcgaaagcagctcatctacagtagacatcttatcctccaattcgagtaacaaagcaccagtttcctcgttggatggtctctcatctctttcactttctacaaaaacaacttcaaatgctgctcctatgatggatttattggatggatttgcccccatcccgccaacagaaaacaatggaccggtttatccatctgtaactgcatttgagagcagctccttgaggttgacattcaatttctcaaaacaaccaggaaacccacaaacaacagttatccaggctacttttatgaatttgtcctccaatacatatacagattttgttttccaggcagcagttcctaagtttcttcagttgcacttagatccagctagcagcaatactcttcccgcaaatgggtccataacccaaagtttgaaaattactaatagccaacatgggaagaaatctcttgtcatgcgtataaggattgcatacaagataaatggcaaggatacactggaggaaggacaagttaataattttcctcgtggtttatga

SEQ ID NO: 288 - protein, 871 aa, Glycine max
MNPFSSGTRLRDMIRAIRACKTAAEERAVVRKECAAIRAAINENDNDYRHRNLAKLMFIHMLGYPTHFGQMECLKLIASPGFPEKRIGYLGLMLLLDERQEVLMLVTNSLKQDLNHTNQYIVGLALCALGNICSAEMARDLAPEVERLLQFRDPNIRKKAALCSIRIIKKVPDLAENFINPATSLLREKHHGVLITGVQLCTDLCKISTEALEHIRKKCTDGLVRTLKDLANSPYSPEYDIAGITDPFLHIRLLKLLRVLGEGNADASDTMNDILAQVATKTESNKVAGNAILYECVQTIMSIEDNGGLRVLAINILGRFLSNRDNNIRYVALNMLMKAVTADAQAVQRHRATIIECVKDSDASIQKRALELVYVLVNETNVKPLAKELIDYLEVSDLDFRGDLTAKICSIVAKYSPEKIWYIDQMLKVLSQAGNFVKDEVWYALIVVITNASELHGYTVRALYRAFQMSAEQETLVRVTVWCIGEYGDMLVNNVGMLDIEDPITVTEFDAVDVVEIAIKRHASDLTTKSMALVALLKLSSRFPSCSERIKEIIVQFKGSFVLELQQRAIEFNSIIAKHQNIRSTLVERMPVLDEATSIGRRAGSLPGAASTPTAPSFNLPNGTAKPVAPLVDLLDLSSDDAPAPSSSSGGDILQDLLGVDLSPASQQSVAGQASKSGNDVLLDLLSIGSPSVESSSSTVDILSSNSSNKAPVSSLDGLSSLSLSTKTTSNAAPMMDLLDGFAPIPPTENNGPVYPSVTAFESSSLRLTFNFSKQPGNPQTTVIQATFMNLSSNTYTDFVFQAAVPKFLQLHLDPASSNTLPANGSITQSLKITNSQHGKKSLVMRIRIAYKINGKDTLEEGQVNNFPRGL

SEQ ID NO: 289 - DNA, 2619 bp, Medicago truncatula
atgaatcctttctcttcaggaacgcgtttgagggacatgattcgggccatacgtgcatgcaagactgcagcagaagagcgcggcgttgtaagaaaagaatgcgcagccattcgtgcttcaataaatgaaaatgaccaagactacaggcatcgtaatatggctaagctaatgtttatccacatgcttggatacccaacacatttcggtcaaatggagtgtctcaagttgatagcatcccctggatttccggagaagagaataggttatcttggcctcatgttgcttcttgatgaaagacaagaagttctaatgttggtcaccaattctttgaaacaagatcttaatcatacaaatcagtatatagtgggacttgcactctgtgctttaggaaacatttgttcagcagaaatggctcgtgatcttgcaccagaggttgagagattgctacaatttcgtgatcccaatattcggaagaaggcagcattgtgctctataaggatcataaagaaagttccagacttggcagaaaattttatcaatcctgctacttcattacttagggagaaacaccatggagttttaattactggagttcagctttgtacagatctgtgtaaaactagcacagaagctcttgaacatattaggaagaaatgcacagatggtttggtcagaactctcaaagatctagcgaacagtccttattcgccagagtatgatattgctggcatcacagacccatttctccacattaggttgcttaaacttctgcgagtgttaggtgaaggtgatgctgatgctagtgactctatgaatgacatacttgcccaggtggctacaaaaaccgagtcaaataaagttgcagggaatgccattttatatgagtgtgttcaaacgataatgagcattgaagataacggtggcttacgcgtacttgccatcaatatcctgggaagattcttgtcaaaccgcgacaacaatatcagatacgtggcattaaacatgctaatgagggctgtaactgctgatgctcaggcagtgcagaggcaccgtgcaacaattctagaatgtgtgaaggatttagatgcttcaattcggaaaagagcccttgaacttgtatatgttctggtaaatgaaactaatgtgaagcctttagtgaaagatcttgtagattatctggaagtcagtgatcttgatttcagaggagacctaactaccaaaatatgctccatagttgcaaagttttccccagagaagatctggtacattgatcagatgctgaaggttctgactgaggctggaaattttgtaaaagatgaagtatggtatgccttaattgttgtgataagcaatgcttccgagcttcatggatattcagtaagagcattatacagggcatttcaaacgtctgctgagcaggagactctagttcgagttacagtgtggtgcattggggagtatggtgacatgttagtccataatgttggaatgcttggcatagaagatccaataacagtgactgagtcagatgcagtggatgttgtagagattgctataaaacgccatgcatcagatcttactacaaaagcaatgtctttggctgccttattaaagctctcttcacgtttcccttcttgttcagagaggatcgaggaaattattgtacagttcaaagggaaccttgagctagaattgcagcagagagctattgaattcaactcgattattgctaagcaccaaaatattagatctactcttgtagaaaggatgccagttttggatgaggccactttcataggtaggagggctgggtctttaccaggtgccgcttctacagcaaatgcaccttcagtcagtctcccgaatggggtagccaaacctgcagctcctcttgtagatctacttgatctaagttctgatgatgctccagcacctagctcttctggtggcgattttcttcaggaccttcttggtgttgatctatctccagcatcacagcaatatggtgttggtcaagcatcaaacagtggcacagatgttcttatggatcttttgtcgattggatcgccttctgccccgagcagctcatctacagtagacatcttgtccttaagtgctagtaataatgcacctgcttcaccattggatgatctctcaccacttccaccttcttcaagagctacttcaaatgctggttcaatgatggatttattgggtggtatttcctccagtccggcaacagaaaacaatggaccagtttacccgtctgtaactgcttttgagagcagctccttgaggttgacattcaatttctcaaaacaaccaggaaacccacaaacaacagttatccaagctacctttacaaatttgtcctccaatacatatacagattttgttttccaggctgcagtccccaagtttctacaattgcacttggatccagctagcggcaatactctccctgctgctggaaatgggtcggtcacgcaaactttgagagttactaatagccaacatggaaagaaatctcttgtcatgcgcataaggatagcatacaaggtaaatggcaaagatacattggaggaaggacaaatcagtaattttcccaagggtctgtga

SEQ ID NO: 290 - protein, 872 aa, Medicago truncatula
MNPFSSGTRLRDMIRAIRACKTAAEERGVVRKECAAIRASINENDQDYRHRNMAKLMFIHMLGYPTHFGQMECLKLIASPGFPEKRIGYLGLMLLLDERQEVLMLVTNSLKQDLNHTNQYIVGLALCALGNICSAEMARDLAPEVERLLQFRDPNIRKKAALCSIRIIKKVPDLAENFINPATSLLREKHHGVLITGVQLCTDLCKTSTEALEHIRKKCTDGLVRTLKDLANSPYSPEYDIAGITDPFLHIRLLKLLRVLGEGDADASDSMNDILAQVATKTESNKVAGNAILYECVQTIMSIEDNGGLRVLAINILGRFLSNRDNNIRYVALNMLMRAVTADAQAVQRHRATILECVKDLDASIRKRALELVYVLVNETNVKPLVKDLVDYLEVSDLDFRGDLTTKICSIVAKFSPEKIWYIDQMLKVLTEAGNFVKDEVWYALIVVISNASELHGYSVRALYRAFQTSAEQETLVRVTVWCIGEYGDMLVHNVGMLGIEDPITVTESDAVDVVEIAIKRHASDLTTKAMSLAALLKLSSRFPSCSERIEEIIVQFKGNLELELQQRAIEFNSIIAKHQNIRSTLVERMPVLDEATFIGRRAGSLPGAASTANAPSVSLPNGVAKPAAPLVDLLDLSSDDAPAPSSSGGDFLQDLLGVDLSPASQQYGVGQASNSGTDVLMDLLSIGSPSAPSSSSTVDILSLSASNNAPASPLDDLSPLPPSSRATSNAGSMMDLLGGISSSPATENNGPVYPSVTAFESSSLRLTFNFSKQPGNPQTTVIQATFTNLSSNTYTDFVFQAAVPKFLQLHLDPASGNTLPAAGNGSVTQTLRVTNSQHGKKSLVMRIRIAYKVNGKDTLEEGQISNFPKGL

SEQ ID NO: 291 - DNA, 2613 bp, Oryza sativa
atggacctcgccatcaaccccttctcctccggcacccgcctccgggacatgatacgggcgatacgcgcgtgcaagacggcggcggaggagcgggcggtggtgcggcgggagtgcgcggcgatacgggcggccatcagcgagggggaccaggactaccgccaccggaacatggccaagctcatgttcatccacatgctcgggtaccccacccacttcggccagatggagtgcctcaagctcatcgccgccgcgggcttccccgagaagcgcatcgggtacctcggcctcatgctgctgctcgacgagcggcaggaggtgctcatgctcgtcaccaactcgctcaagcaagatcttaaccactcgaaccagttcattgtggggcttgcactctgtgctcttggcaacatttgctccgctgaaatggcgcgtgatctgtcacctgaggtggagaggctattgcaaagtagggaaccaaataccaagaagaaggctgccttatgctctataaggatcgtacggaaggttccagatttggcagagaacttcatgggctctgctgtttcactactgaaggaaaaacatcacggggttctcatatctgctgttcagctctgcgcagaactttgtaaagcaagcaaagaggcattggagtacctgaggaagaactgccttgatggtttggtcagaatactgagagatgtgtccaatagttcatatgctcctgaatatgacattgctggaattacggatccgttcttgcatatcagagtgcttaagctcatgcgaattttgggtcaaggagatgcagattgcagtgagtttgtgaatgatattcttgctcaggttgcaacaaaaactgagtcaaataagaacgcaggaaatgctattttatatgaatgtgttgagactataatgggcatcgaagctactagtggtttacgtgtgctggcaatcaatatcttgggtagatttctgtccaaccgtgataataacatcagatatgttgctctgaacatgcttatgaaggccatggaggtagacacgcaagcagtgcagaggcatagagcaacaatattagagtgtgtcaaggatgctgatgtatctattcgcaaaagggcccttgaacttgtttaccttcttgtcaacgatgcaaatgcaaaatctttgaccaaggagcttgttgattacctggaagtaagtgatcaggacttcaaggacgacctcacagcaaagatatgctcaattgttgaaaagttttcccaagataaactttggtacttagaccagatgttcaaggttttatctctggctggaaattatgtgaaggacgatgtatggcatgctctaatagtcttaataagcaatgcatctgaactccaaggatactcagtgagatcattatacaaggcattgctagcttgcggtgaacaggaaagtttggttagggtagctgtatggtgcattggtgagtatggtgaaatgctggtgaacaatgttggtatgctggacatagaggaaccaatcacggtaacagaatctgatgccgtggatgctgtagaggtctctcttaaacgatactctgcagacgtgacaactcgggctatgtgtctagtatctctcttgaagctctcttcccgattcccaccgacttcagagaggataaaggaaatagttgcacagaataaagggaatactgtgcttgaactacaacagaggtcaattgaattcaactccattatacagaggcatcagtctataaaatcatctttgcttgagcggatgcctgtgatagatgaagctagttacttggctaagagagctgcttccacacaagcaactatttcatcagataaattagctgctgcagcaactcctggaagctcgcttaagcttccaaatggtgtagcaaagccaccaccggctcctctagctgatttgcttgatttaagttctgacgatgctcctgcgactacttccgcccctactacagcacctaatgatttcctacaggatcttttgggcataggcttgactgatacatctacagcaggtggagctccatcagcaagcacagatattctgatggatcttctatcaattggttcttctccagtacaaaatggcccaccaacagtatcaaactttagccttcctggtcaagctgagactaaagttgcacctgttacaccccaagttgtggatcttcttgatggtttgtcctcaagcacatctctttctgatgagaatacagcttacccgccaatcacagctttccagagtgcagctttgaagatcactttcaattttaagaagcagtctggaaaacctcaggagactacaattcatgctagctttacaaatttgacatctaatacattcacggatttcatctttcaggcagctgtaccaaagtttatccagttgcgtttggaccccgctagcagcaacacgcttcctgccagtggaaatgattctgttacacaaagcctcagtgtcacaaataaccaacatggacagaaaccccttgcgatgcgtatccggataacttacaaagtgaacggtgaggacaggctggagcaagggcaaatcaacaattttcctgctggattgtag

SEQ ID NO: 292 - protein, 870 aa, Oryza sativa
MDLAINPFSSGTRLRDMIRAIRACKTAAEERAVVRRECAAIRAAISEGDQDYRHRNMAKLMFIHMLGYPTHFGQMECLKLIAAAGFPEKRIGYLGLMLLLDERQEVLMLVTNSLKQDLNHSNQFIVGLALCALGNICSAEMARDLSPEVERLLQSREPNTKKKAALCSIRIVRKVPDLAENFMGSAVSLLKEKHHGVLISAVQLCAELCKASKEALEYLRKNCLDGLVRILRDVSNSSYAPEYDIAGITDPFLHIRVLKLMRILGQGDADCSEFVNDILAQVATKTESNKNAGNAILYECVETIMGIEATSGLRVLAINILGRFLSNRDNNIRYVALNMLMKAMEVDTQAVQRHRATILECVKDADVSIRKRALELVYLLVNDANAKSLTKELVDYLEVSDQDFKDDLTAKICSIVEKFSQDKLWYLDQMFKVLSLAGNYVKDDVWHALIVLISNASELQGYSVRSLYKALLACGEQESLVRVAVWCIGEYGEMLVNNVGMLDIEEPITVTESDAVDAVEVSLKRYSADVTTRAMCLVSLLKLSSRFPPTSERIKEIVAQNKGNTVLELQQRSIEFNSIIQRHQSIKSSLLERMPVIDEASYLAKRAASTQATISSDKLAAAATPGSSLKLPNGVAKPPPAPLADLLDLSSDDAPATTSAPTTAPNDFLQDLLGIGLTDTSTAGGAPSASTDILMDLLSIGSSPVQNGPPTVSNFSLPGQAETKVAPVTPQVVDLLDGLSSSTSLSDENTAYPPITAFQSAALKITFNFKKQSGKPQETTIHASFTNLTSNTFTDFIFQAAVPKFIQLRLDPASSNTLPASGNDSVTQSLSVTNNQHGQKPLAMRIRITYKVNGEDRLEQGQINNFPAGL

SEQ ID NO: 293 - DNA, 1694 bp, Physcomitrella patens
atgactactgggagtagattattggacatgatacggtccattcgagcttgtaaaactgcagctgaggagagaagtgtagttgcaaaagagtgcgccttacttcgaaatgcttttaaagataatgaccaggattatcgacaccgcaacgttgccaagcttatgttcatccatatgctgggctatcccactcactttggtcagatggaatgcatcaagttgatcgctgcaggctcctttcctgagaaaagaattggttacctgggtctcatgttactgcttgatgagcgccaggaagtgttgatgttggttaccaattctttgaaaaatgacttgggccacaccaatcagtttattgttgggttaggactttgcgctctcggcaatatttgtaccgctgaaatggctagggatcttgctccagaagttgaaaaacttttacaaagcaacaactcctacattcgtaagaaggcagcgttgtgttccgtgaggatcgttcggaaggtgccggaccttgttgagtatttgacggttccagctacaggacttctcacagacaagcatcatggggttctggtagcaggagtaaagctttgtacagagctttgtcaatccaacgagctagcccttgaacattttaggaagcatgtgtcgacaatggtccgggtgctgaagaacctggttgtcagtggttatgctcctgagtatgatgtcagtggaattacagacccctttttacaaatcaggcttcttagattgctgcgcctacttgggaatggtgatgccgatgtcagcgatgcaatgagtgatgtccttgcgcaggttgcaacgaacacagaaagcaacaagaatgcgggcaacgctattttatacgagtgtgtacagacaatcatggccgtagaggctattggaggccttcgcgtattggctatcaacattttgggtcgctttttggctaatcgtgataacaatataagatatgtagcattgaacacccttgtcaaggtcgtatcagtcgatactcaagccgtccagcggcatcgtacgacgattgttgaatgtgtgaaggattcagatatttccattagaagacgagctttggagcttgtctgtgctttggtgaatgaaaacaacgtcaaggttttaacaaaggagttggttgaatatctgaaagtcagtgatcctgactttaagggagacctcactgcaaggatagctggacttgttcaaaaatttgcgccaaacaagcagtggtacattgatcagatgatattgctcatggttgaggctgggaaatatgttaccaatgaagtgatcaggtctttggtagtcgttataagcaatgcaaatgatcttcaaggctatgttgttcgaaccctttaccgagtatttcaagcgtgggatgggcaggaaagtcttggacaagtcactgtttggtgtattggtgagtatggagagtttttaattaacagtgctaatgaattggaaggcgaagatccactcactgttgcagaatcagacgctgtggatgttgttgaaagtgtcttaaaagactcgagagtaacacccaccacagtagcatttgcacttacggcgcttctgaaactctcaactcgtttacctacctgtgcagaccgcatcaagaacttgattttagaacataaaggaagtttggtactggagttgcaacaacgggc

SEQ ID NO: 294 - protein, 885 aa, Physcomitrella patens
MTTGSRLLDMIRSIRACKTAAEERSVVAKECALLRNAFKDNDQDYRHRNVAKLMFIHMLGYPTHFGQMECIKLIAAGSFPEKRIGYLGLMLLLDERQEVLMLVTNSLKNDLGHTNQFIVGLGLCALGNICTAEMARDLAPEVEKLLQSNNSYIRKKAALCSVRIVRKVPDLVEYLTVPATGLLTDKHHGVLVAGVKLCTELCQSNELALEHFRKHVSTMVRVLKNLVVSGYAPEYDVSGITDPFLQIRLLRLLRLLGNGDADVSDAMSDVLAQVATNTESNKNAGNAILYECVQTIMAVEAIGGLRVLAINILGRFLANRDNNIRYVALNTLVKVVSVDTQAVQRHRTTIVECVKDSDISIRRRALELVCALVNENNVKVLTKELVEYLKVSDPDFKGDLTARIAGLVQKFAPNKQWYIDQMILLMVEAGKYVTNEVIRSLVVVISNANDLQGYVVRTLYRVFQAWDGQESLGQVTVWCIGEYGEFLINSANELEGEDPLTVAESDAVDVVESVLKDSRVTPTTVAFALTALLKLSTRLPTCADRIKNLILEHKGSLVLELQQRAIEFGSILTKHSELKATLLERMPVLDEATYSAKNEMGVDGQQTAAAVASESDANGHLKQPNGIGKQPAATANLMDLLSFTDEQPSTSSNSSGNALLDLLGNGPLDGSNSLTSSAKHSAGGADMLLDLLSLDGPAPPTSAPTSTAAAPLAGLLDVDPLGNIPLGNLSLSGGTPRGPPAVVDPFANLTSTAMLASVPSPDPAPGFPTIVAMQTSGLKISFDFTKPADSPKTTIIKAFYSNLSSNPYTDFVFQAAVPKFMQLQLEPATSGILPANSTNSVTQLIRLTNNMHGQKALVMKLRVSYKANGNNVLEQGQVNNFPAGL

SEQ ID NO: 295 - DNA, 2634 bp, Populus trichocarpa
atgaattcgttcttttccggtacgcgtcttagggacatgattcgggcaatacgggcttgtaaaacggcggcggaggaaagagctgttgtgagaaaagaatgtgctgcaattcgaacgtcgattaatgaaaatgatcaagattatagacaccggaatttggcaaagcttatgtttattcatatgcttggctacccaacacattttggtcaaatggagtgcttaaagttgattgcctccgccggatttcctgaaaagaggatcggatatctcggcctcatgttacttcttgatgaaagacaagaagttctaatgctcgttaccaactcgctaaaacaagatcttaatcattcaaaccagtatattgtgggacttgcactttgtgctttgggaaatatttgttcagcagaaatggctcgtgatcttgcaccagaagtggaaagattgctgcaatttcgggatccaaatattcggaaaaaggctgcattatgctctatacggattattaggaaagtcccggatctggcagaaaattttataaatcctgcggctgccttactaaaagagaagcatcatggagtcttaataacgggaattcaactctgtacagatttatgtaaagtcagtccggaagccctcgagtttttgagaaagaaacacacagaagggttggtcagaactttaaaggatgttgttaacagtccatatgcaccggaatatgacattgccggtatcgcggacccttttctccatgtcagattgctcaaacttttgcgtgcgttgggccaaggagatgctgatgctagtgatgccatgaatgacatacttgctcaggtggcaacaaaaactgagtcaaacaaaaatgctggaaatgctattctatatgaatgtgttgaaactatcatgagcattgaagataatggtggcctacgagtgcttgctattaatatcctgggaagatttttgtctaaccgtgacaataatatcagatatgttgcattaaacatgctgatgaaggctattactgtagatgctcaagctgtacaaaggcatcgggcaacaatcttggaatgtgtaaaggattcagatgcttcaatcaggaaaagggcccttgaacttgtttacgttctggtgaacgagaccaatgtaaaacctttgacaaaagagctaattgattatctggaagtaagtgatgaagaatttaaaggggatcttactgccaaaatttgctccattgttgagaagttctcccctgagaaaatttggtacattgatcagatgctcaaggttcttgctgaggctggaaactttgtaaaagatgaagtatggcatgcccttattgttgtgataagcaatgcttccgaccttcatggatatacagtcagggcattgtacaaagctttccaaacatcttctgagcaggaaagccttgttcgcgtagcagtttggtgcattggggaatacggtgacatgttgatgaataatgttggaatgcttgccatagaggatcctgtaactgttacggagtctgacattgtggatgttgttgagattgctttaaagcaccatgccttagacctcactactaaagcaatggctctgattgctctcttaaaactttcttcccgtttcccatcttgttctgaaaggatcaaggatataattgttcaccataaaggcagccttgtgcttgaattgcagcaaagatcccttgaatttaattccatcattgagaagcatcaaaatataagatctacactggtcgaaaggatgccaattttggatgaggctactttcactacaaggagggctggttctttgccagcagctgtttcaacttctggtggggcttcccttaatcttccaaatggagttgtgaagccctccacagctcctcttgtagatttacttgatctttcagatgatgttccagcagcacccggctcttctggtggtgattttcttcaggatcttctaggtgttgatttgtcaccagctccaacacaatcaggcacaaaccaggttcaaaaagctggcacagatgttctactggatctattgtcaattggagtgcctcctgtacaaagcagctcatctacaactgacattttatcacccattcaaaatgaaaaatcaccaatagccacattagatgcactctcgtcatcttcttcaccttctgcacaagcaacttcttctgctagagctgctccaatgatggatttgttggatggcttcggtcccagcccatcaaaacctgagaataatggttcagtttatccacctttcgtggcatttgagagcagctctttgagaataacattcaacttctcaaagcaaccaggaaacccgcaaacaacattagtccaggcaactttcacaaacttgacacccaatgtcttcaccgattttatatttcaggcagcagttccaaagtttcttcaactgcacctagacccagctagcagcaatattcttcctgcaagtggtaatggatccattacacaaaatatgagagttactaataaccaacacgggaagaaatccctcgtgatgcgcacaaggatatcatacaagatcaacaacaaagatacactggaggaaggacacataaacaatttcccgcgtgagttgtga

SEQ ID NO: 296 - protein, 877 aa, Populus trichocarpa
MNSFFSGTRLRDMIRAIRACKTAAEERAVVRKECAAIRTSINENDQDYRHRNLAKLMFIHMLGYPTHFGQMECLKLIASAGFPEKRIGYLGLMLLLDERQEVLMLVTNSLKQDLNHSNQYIVGLALCALGNICSAEMARDLAPEVERLLQFRDPNIRKKAALCSIRIIRKVPDLAENFINPAAALLKEKHHGVLITGIQLCTDLCKVSPEALEFLRKKHTEGLVRTLKDVVNSPYAPEYDIAGIADPFLHVRLLKLLRALGQGDADASDAMNDILAQVATKTESNKNAGNAILYECVETIMSIEDNGGLRVLAINILGRFLSNRDNNIRYVALNMLMKAITVDAQAVQRHRATILECVKDSDASIRKRALELVYVLVNETNVKPLTKELIDYLEVSDEEFKGDLTAKICSIVEKFSPEKIWYIDQMLKVLAEAGNFVKDEVWHALIVVISNASDLHGYTVRALYKAFQTSSEQESLVRVAVWCIGEYGDMLMNNVGMLAIEDPVTVTESDIVDVVEIALKHHALDLTTKAMALIALLKLSSRFPSCSERIKDIIVHHKGSLVLELQQRSLEFNSIIEKHQNIRSTLVERMPILDEATFTTRRAGSLPAAVSTSGGASLNLPNGVVKPSTAPLVDLLDLSDDVPAAPGSSGGDFLQDLLGVDLSPAPTQSGTNQVQKAGTDVLLDLLSIGVPPVQSSSSTTDILSPIQNEKSPIATLDALSSSSSPSAQATSSARAAPMMDLLDGFGPSPSKPENNGSVYPPFVAFESSSLRITFNFSKQPGNPQTTLVQATFTNLTPNVFTDFIFQAAVPKFLQLHLDPASSNILPASGNGSITQNMRVTNNQHGKKSLVMRTRISYKINNKDTLEEGHINNFPREL

SEQ ID NO: 297 - DNA, 489 bp, Brassica napus
atggctcctattgctgtcggcgatgttgtaccagaaggaactatctccttctttgatgagaatgatcagcttcagagcgcctccgttcacactctcgccgctggtaagaaggtcattctcttcggtgtccccggtgctttcactcccacatgcagcatgcagcatgtgcctggattcattgagaaagccgaggagctgaaatcaaagggtgttgatgagatcatttgcttcagcgtgaacgatccatttgtgatgaaggcgtggggaaagacataccctgagaacaagcacgtgaagtttgtggcagatggttcaggagaatacacacagcttcttggactcgagcttgacctcaaggacaagggtcttggtgttaggtcaaggagattcgctctgctgctcgataacctcaaggtgactgtggccaatgttgaatccggtggcgagttcacggtttccagcgctgatgatatcctcaaggctctctaa

SEQ ID NO: 298 - protein, 162 aa, Brassica napus
MAPIAVGDVVPEGTISFFDENDQLQSASVHTLAAGKKVILFGVPGAFTPTCSMQHVPGFIEKAEELKSKGVDEIICFSVNDPFVMKAWGKTYPENKHVKFVADGSGEYTQLLGLELDLKDKGLGVRSRRFALLLDNLKVTVANVESGGEFTVSSADDILKAL

SEQ ID NO: 299 - DNA, 489 bp, Gossypium hirsutum
atggctccgatcgctgtcggcgacgtgttaccggacggtactctctcctacttcgacgccgatgataagctccagcaggtgtccgtacattccctggctgccggtaaaaaggttatcatctttggcgttcccggtgcctttacccctacttgcagcttgaagcatgttcctggattcatcgagaaagcaggggagctgaaatccaagggcgttgatgaaattatttgcattagcgtgaatgacccctttgtgatgaaggcatgggccaaaacttaccctgagaacaaagatgtcaagtttctagctgatggttcagcaacatacacccatgcccttggtcttgagctcaaccttggcgataaaggtctcggcactcggtctaggaggttcacactcttggtcgatgacctcaaggtgaaggcagcaaatgtcgaatctggaggggagtttaccgaggcaagggctgatgatatgcttgaagctctatag

SEQ ID NO: 300 - protein, 162 aa, Gossypium hirsutum
MAPIAVGDVLPDGTLSYFDADDKLQQVSVHSLAAGKKVIIFGVPGAFTPTCSLKHVPGFIEKAGELKSKGVDEIICISVNDPFVMKAWAKTYPENKDVKFLADGSATYTHALGLELNLGDKGLGTRSRRFTLLVDDLKVKAANVESGGEFTEARADDMLEAL

SEQ ID NO: 301 - DNA, 489 bp, Glycine max
atggctccaattactgtcggcgatgttgtaccagacggaactatctctttcttcgatgaaaatgatcagcttcagaccgtctccgttcactctatcgccgccggtaaaaaagtcattctctttggtgttcctggtgctttcactcccacatgcagtatgagccatgtgcctggattcattgggaaagcagaggagctgaagtcaaagggtattgatgagatcatttgctttagtgtgaatgatccatttgtgatgaaggcatggggaaaaacatatccagagaacaagcatgtgaagtttgtagcagatgggtctggagaatacacgcatcttcttggacttgagcttgaccttaaggacaagggtcttggtattaggtcaaggagattcgctttgttgcttgataaccttaaggtgactgtagccaatgttgaatctggtggcgagttcacggtttccagcgcagaggatattctcaaggctctttaa

SEQ ID NO: 302 - protein, 162 aa, Glycine max
MAPITVGDVVPDGTISFFDENDQLQTVSVHSIAAGKKVILFGVPGAFTPTCSMSHVPGFIGKAEELKSKGIDEIICFSVNDPFVMKAWGKTYPENKHVKFVADGSGEYTHLLGLELDLKDKGLGIRSRRFALLLDNLKVTVANVESGGEFTVSSAEDILKAL

SEQ ID NO: 303 - DNA, 489 bp, Hordeum vulgare
atggctccgattggcgtgggcagcaccctccccgacgggcagctcgggtggttcgacgagaacgaccagctgcagcaggtctcgatccactccctggccgccggcaagaaggtcatcctcttcggcgtccccggcgccttcacccccacctgcagcaatcagcatgtaccaggcttcattactcaagctgaggatctcaaagccaagggtgtagaggagattcttcttgtcagcgttaatgacccctttgtcatgaaggcatgggcaaagacatacccagagaacaagcatgtgaagttccttgctgatggagcggcagcatacacaaaagcacttggtcttgagcttgatctcacggagaagggattgggtcttcgttcgaagcgctttgctctccttgctgacgacctcaaggtcaccgtcgcaaacatcgaggaaggaggccagttcacaatctctggtgctgaagagatcctcaaggcactgtag

SEQ ID NO: 304 - protein, 162 aa, Hordeum vulgare
MAPIGVGSTLPDGQLGWFDENDQLQQVSIHSLAAGKKVILFGVPGAFTPTCSNQHVPGFITQAEDLKAKGVEEILLVSVNDPFVMKAWAKTYPENKHVKFLADGAAAYTKALGLELDLTEKGLGLRSKRFALLADDLKVTVANIEEGGQFTISGAEEILKAL

SEQ ID NO: 305 - DNA, 489 bp, Medicago truncatula
atggctccaatcaaagtcggagatgtgatcccagatggcaccttagccttccttgatgaagaaaacaaacctcaatctgtcaccattcattccctctctgctggcaaaaaagtcatcatctttgctgttcctggtgccttcacccccacttgcagcttgaagcatgttcctggcttcattgagagatcagaagagctgaaaggaaagggagttgatgaaatcatctgtatcagtgtcaatgatccatttgtgctgaattcatgggccaagacattcccagagaacaagcatgtcaagttccttgctgatggttctgccaaatacacacatgctcttgggttggagcttgacctcagcgacaaaggtcttggcattcgctccaagaggtttgctcttcttgttgaagacttgaaggtgaaggttgcaaatgttgaagaggggggagaatacaccatctccggtgctgaagaaatcatcaaggctctttga

SEQ ID NO: 306 - protein, 162 aa, Medicago truncatula
MAPIKVGDVIPDGTLAFLDEENKPQSVTIHSLSAGKKVIIFAVPGAFTPTCSLKHVPGFIERSEELKGKGVDEIICISVNDPFVLNSWAKTFPENKHVKFLADGSAKYTHALGLELDLSDKGLGIRSKRFALLVEDLKVKVANVEEGGEYTISGAEEIIKAL

SEQ ID NO: 307 - DNA, 489 bp, Oryza sativa
atggccccggttgccgtgggcgacaccctccccgacggccagctggggtggttcgacggggaggacaagctgcagcaggtctccgtccacggcctcgccgccggcaagaaggtcgtcctcttcggcgtccccggtgccttcaccccgacctgcagcaatcagcatgtgccaggattcataaatcaggctgagcagctcaaagccaagggtgtagacgacatcttgcttgtcagtgttaacgacccctttgtcatgaaggcgtgggcaaagtcataccctgagaataagcatgtgaaattccttgccgatggtttgggaacatacaccaaggcacttggtcttgagcttgacctttcggagaaagggcttggtattcgttcgagacggtttgctctccttgctgacaacctcaaggttactgttgcaaacattgaggaaggtggccaattcacaatctctggtgctgaggagatcctcaaggcactgtaa

SEQ ID NO: 308 - protein, 162 aa, Oryza sativa
MAPVAVGDTLPDGQLGWFDGEDKLQQVSVHGLAAGKKVVLFGVPGAFTPTCSNQHVPGFINQAEQLKAKGVDDILLVSVNDPFVMKAWAKSYPENKHVKFLADGLGTYTKALGLELDLSEKGLGIRSRRFALLADNLKVTVANIEEGGQFTISGAEEILKAL

SEQ ID NO: 309 - DNA, 492 bp, Physcomitrella patens
atggcccccattgcagtgggtgatacgatccccgacgtgacgctatcctacttggacgatgacaaccagagccagaagctcagcacgcaccaggatttgaaaggcaagaaagtgatgcttgttgctgttcctggcgcattcactcccacttgcagccaggaacacgttcccggtttcatcgacaatgccaaggagatcaagagcaagggtgtgtcggacatcatcgtcgtctcagtgaatgacccgttcgtcatgaaggcatgggagcgttcctatgatggtgctgaacacctcaagtttgtggccgatggttctctagagttcaccaaggcgttgggattggagctggacttgaccgacaagggattgggcgtacgttctcgtagattctgtctactggtcgatgacttggttgtgaaggttgcgaacattgaggaaggaggtgcattcacagtttccggagctgaggaaatcttgaaggcgctcgtgtga

SEQ ID NO: 310 - protein, 163 aa, Physcomitrella patens
MAPIAVGDTIPDVTLSYLDDDNQSQKLSTHQDLKGKKVMLVAVPGAFTPTCSQEHVPGFIDNAKEIKSKGVSDIIVVSVNDPFVMKAWERSYDGAEHLKFVADGSLEFTKALGLELDLTDKGLGVRSRRFCLLVDDLVVKVANIEEGGAFTVSGAEEILKALV

SEQ ID NO: 311 - DNA, 483 bp, Populus trichocarpa
atggctccgattgctgtcggtgatgtcttgcctgatggaaagctcgcttatttcgacgaacaagatcagctccaggacgtgtctgtacactctcttgctgccggtaaaaaggtcatcctctttggtgttcccggtgccttcacccccacttgcagcttgaagcatgtgccagggtttgttgagaaagcagaggagcttaaatccaagggggttgctgaaattttgtgcatcagcgtgaatgacccctttgtgatgaaagcatgggcaaaaacttaccctgagaataagcatgtcaaattcctagctgatggatctgcaacatacacccatgctcttggccttgagcttgacctgcaagagaagggacttggcacccgttctaggaggtttgctctcttggtcgatgacctcaaggtgaaagctgcaaatattgaaggtggtggagaattcactgtgtccagtgctgatgatatcctcaaggat

SEQ ID NO: 312 - protein, 162 aa, Populus trichocarpa
MAPIAVGDVLPDGKLAYFDEQDQLQDVSVHSLAAGKKVILFGVPGAFTPTCSLKHVPGFVEKAEELKSKGVAEILCISVNDPFVMKAWAKTYPENKHVKFLADGSATYTHALGLELDLQEKGLGTRSRRFALLVDDLKVKAANIEGGGEFTVSSADDILKDL

SEQ ID NO: 313 - DNA, 489 bp, Solanum lycopersicum
atggctccaatcgccgttggtgacgtcatccccgatggtaccgtatcttacttcgacgagcaagatcagatgcagaccgtctcagtatactcacttgctaagggcaagaaggtcatcatcttcgccgttcccggagctttcactcccacttgcagcatgaagcatgtgcctggctttattgaaaaggctgctgagttgaagtcaaagggtgtcgatgaaatcctctgcatcagtgtcaatgacccctttgtgatgaaggcctgggcaaaaacttaccctgagaacaaacatgtaaaatttcttgctgatggagctggaaaatacacccatgcccttgggctggagcttgatctgtcggataaggggcttggtgttcgatcacgaaggtatgctcttttggttgatgaccttgaggtgaaagtagctaacattgaatctggaggggagttcacggtctccggtgctgatgaaatcgtcaatgctctttaa

SEQ ID NO: 314 - protein, 162 aa, Solanum lycopersicum
MAPIAVGDVIPDGTVSYFDEQDQMQTVSVYSLAKGKKVIIFAVPGAFTPTCSMKHVPGFIEKAAELKSKGVDEILCISVNDPFVMKAWAKTYPENKHVKFLADGAGKYTHALGLELDLSDKGLGVRSRRYALLVDDLEVKVANIESGGEFTVSGADEIVNAL

SEQ ID NO: 315 - DNA, 489 bp, Triticum aestivum
atggctccgattggcgtgggcagcaccctccccgacggccagctcgcgtggttcgacgagaacgaccagatgcagcaggtctccatccactcgttggccgccggcaagaaggtcatcctcttcggcgtccccggtgccttcacccccacctgcagcaatcagcatgtaccaggcttcattactcaggccgaggagctcaaagccaagggtgtagatgagatcctgcttgtcagcgttaatgacccctttgtcatgaaagcatgggcgaagacatacccagataacaagcatgtgaagttccttgctgatggagcggctgcatacacaaaagcacttggtcttgagcttgatcttacggagaaaggattgggtcttcgttcgaggcggtttgctctccttgctgacgacctcaaggtcaccgtcgcaaacgtcgaggaaggtggccagttcacaatctctggtgccgaggagatcctcaaggcactgtag

SEQ ID NO: 316 - protein, 162 aa, Triticum aestivum
MAPIGVGSTLPDGQLAWFDENDQMQQVSIHSLAAGKKVILFGVPGAFTPTCSNQHVPGFITQAEELKAKGVDEILLVSVNDPFVMKAWAKTYPDNKHVKFLADGAAAYTKALGLELDLTEKGLGLRSRRFALLADDLKVTVANVEEGGQFTISGAEEILKAL

SEQ ID NO: 317 - DNA, 489 bp, Zea mays
atggctcccatcgctgtcggcgacgccctccccgacggccagctcgggtggttcgacgagaacgaccagctgcagcaggtctccgtccacgcgctcgccgccggcaagaaggtcatcctcttcggcgtccccggcgccttcaccccgacctgcagcaaccagcatgtgccaggcttcatcacacaggctgagcagctcaaagccaagggtgtagacgagatcctgcttatcagcgttaacgaccccttcgtcatgaaggcgtgggcgaagacctaccccgagaacaagcacgtgaagttcctcgccgacggatctggagcgtacaccaaggcgctcgacctcgagctcgatctcacggacaaaggtctgggcgtgcgctcgaagaggttcgctctcctggccgacgacctcacggtcaccgtcgcaaacatcgaggaaggcgggcagttcacgatctctggcgctgaggagatcctgaaggcgctttag

SEQ ID NO: 318 - protein, 162 aa, Zea mays
MAPIAVGDALPDGQLGWFDENDQLQQVSVHALAAGKKVILFGVPGAFTPTCSNQHVPGFITQAEQLKAKGVDEILLISVNDPFVMKAWAKTYPENKHVKFLADGSGAYTKALDLELDLTDKGLGVRSKRFALLADDLTVTVANIEEGGQFTISGAEEILKAL

SEQ ID NO: 319 - DNA, 1116 bp, Brassica napus
atgccgccgactgatgctgagttcgatcccaaagtgttgcctcagtccgcgacgggcgactacacattcgcgaacgtggacaatctggagcattgtgcaaagtacttgaaccagacgatggttacatttggattcccggcctcgctcgatctcttctccaacgatccggtttctatctcgaggacctgtaattgcatgtactcgttgcttcagcagcgacagcgcgacttggagttcagagaatctgctaatgagctgaggcagagacaacaatcggatatagctagacttgaagctaaagttgagaggctcgatgcgcagctccaacacaaggacagggaaatcgcaacgattactagaacagaagcgaaaaacacagcggctttgaagtcgcagattgaaaagctacagcaggagagagatgagttccaaagaatggtgatcggtaaccagcaagtcaaagctcaacagatccatgaaatgaagaaaaaggaaaaggattacattaaattacaggaacggttgaatcaagtattgatggagaaaaagaaagaatcgaaatcaggaatggagatcatgaatttgctacagaaagaagggaggcagcgtgggacctggaatggcaagaagactgatactgacttctacaaaaagatagtggatgcatatgaagcaaaaaaccaagagttaatggctgagaacacaaacctaagagcactgcttcgatccatgcagacagatatgcgtgatttcttaaacgctccaaacgggtcagctaatccttcattggctggcaacgagaaacgtgaggccgatccttcacaatctccactgggtggaaagacggatgtctttgatctacctttccgtatggctagaggtcaaatagaagaaagtttgcgcactaagatggcttccataaaggaacgcatggttcagttacaagatgcacctaaaggagcatctgtcacttctgaagcaacagagagagagcttgaacttgaagctcagctagccgaggcaagaagcataatccaagaacaggagtccataatgtgtaaacacctcccaaaatcagagcagcgaaagggaatccatggttccattgacagctga

SEQ ID NO: 320 - protein, 371 aa, Brassica napus
MPPTDAEFDPKVLPQSATGDYTFANVDNLEHCAKYLNQTMVTFGFPASLDLFSNDPVSISRTCNCMYSLLQQRQRDLEFRESANELRQRQQSDIARLEAKVERLDAQLQHKDREIATITRTEAKNTAALKSQIEKLQQERDEFQRMVIGNQQVKAQQIHEMKKKEKDYIKLQERLNQVLMEKKKESKSGMEIMNLLQKEGRQRGTWNGKKTDTDFYKKIVDAYEAKNQELMAENTNLRALLRSMQTDMRDFLNAPNGSANPSLAGNEKREADPSQSPLGGKTDVFDLPFRMARGQIEESLRTKMASIKERMVQLQDAPKGASVTSEATERELELEAQLAEARSIIQEQESIMCKHLPKSEQRKGIHGSIDS

SEQ ID NO: 321 - DNA, 1137 bp, Glycine max
atgcctcccactgacggagacttggatcttaggccaccttctcaatcttccttcacagccggcgactacacgttcgccgatgcggacaatttggagcattgcgctaagtatctcaaccaatcgctcgtcacgtttggtttcccggcttcgctcgatctcttcgcaaatgaccccgtttcaattgcgaggacttgcaattgcatttacgtcttgctgcagcagagacagcgcgacgtggagtttagagagtctgctaatgatcaaagacaacgactgttgtctgacatttcgagattggaggccaaagtggagaggcttgaaggtcaactacaagtcaaagacagggagatagcgactattactagaacggaagctaaaaacactgcagctctgaaggcccaaattgagaagctgcaacaggagagggatgaattccagagaatggttattggtaatcagcaagtaaagactcaacaaatgcatgagatgaagaagaaggaaaaagaatacataaagttgcaggagaggctaaaccaagtgttgatggagaagaagaaagagtctaggtcaggcatggagataatgaatttgcttcagaaggaagggaggcaacgtggaacatggaatgggaagaaagctgacaatgatttttataaaaagattgtggatgcttatgagtcaaaaaatcaagaactgatggcagagaatgctgatttaagagcattattgagatcaatgcaggtggatatgcgtgatttcttaaatgctcctaatggactaccaaagcaatctttcactggcaatgaaagagttgaaagtgatccttcacaatctccattggttgggaaaatggatgtatttgaccttccttttcacatggccagagatcaaatagaagaaagtcttcgcaacaaaatggcttctataaaggagcgtatggttcaattgcaagatgctcaaaaagaagcagaagttacttcagaggctactgagagggaacttgagcttgaagctcaacttgtcgaagcaaggagcatcatacaggagcaggcatcaataatgtctaaacatcttgcaaaatctgacaggccaagggaatctatcatcccagcaccggctgaggcagtatgcaattaa

SEQ ID NO: 322 - protein, 378 aa, Glycine max
MPPTDGDLDLRPPSQSSFTAGDYTFADADNLEHCAKYLNQSLVTFGFPASLDLFANDPVSIARTCNCIYVLLQQRQRDVEFRESANDQRQRLLSDISRLEAKVERLEGQLQVKDREIATITRTEAKNTAALKAQIEKLQQERDEFQRMVIGNQQVKTQQMHEMKKKEKEYIKLQERLNQVLMEKKKESRSGMEIMNLLQKEGRQRGTWNGKKADNDFYKKIVDAYESKNQELMAENADLRALLRSMQVDMRDFLNAPNGLPKQSFTGNERVESDPSQSPLVGKMDVFDLPFHMARDQIEESLRNKMASIKERMVQLQDAQKEAEVTSEATERELELEAQLVEARSIIQEQASIMSKHLAKSDRPRESIIPAPAEAVCN

SEQ ID NO: 323 - DNA, 1218 bp, Medicago truncatula
atgccttccactgaaggagacttagatcttaggccatcttctcattctgctttcacaaccggagaatacacattcgccgatgtaaacaatttggaacattgtgctaagtatctgaaccaatcactcgttacatttggttttcccgcttcactcgatctattctcaaacgatcccgtttctatagcgaggacgtgcaattgcatatacttcttgcttcagcagagacagcgtgatgtcgaatttagagagtctgccaatgaacaaagacaacgattgttgtcggatatatcgagatatgaggctaaagttgagagacttgatggacaattacaagctaaagatagagagatagcgacgataactagaacggaagctaaaaatactgcagctctcaaggctcaaattgagaagctgcaaaaagagagggatgaatttcagaggatggttattggcaatcagcaagttaggactcaacaaatacatgagatgaagaagaaggaaaaggaatacattaagttgcaggagagactaaaccaagtgttgatggagaagaagaaagaatctaggtcgggcatggagataatgaatttgcttcagaaggaagggaggcaacgtggaacatggaatgggaagaaaactgacaatgatttttataaaaagattgtggacgcttatgaggtgaaaaatcaagaactgatagcagaaaatgctgatttaagggcattattgagatcaatgcaggttgatatgcgtgatttcttaaatgctcctaatggactaccaaatcaatctcccactactaacgaaagatctgaaagtaatccttcacattctccgctggttggaagaacggacgtatttgatcttccttttcacatggcaagagatcaaattgaagagagtctaagagcgaagatggcttctataaaggagcgcatggtccaactgcaagatgctcagaaagaggccgaagtcacttcggaagctaccgagagagaacttgagcttgaagctcaacttgttgaagcaaggagcattatacaagagcaggcttctataatgtctaaacatcttgcaaagtctgacaggccaagtaaattgatttactctttgaattttacagggaatcggctccggctgaggggtagtgctagactgggagcacatgttggtgtagaaacggtgttgatgatggcatttagcatcaaccttttgtga

SEQ ID NO: 324 - protein, 405 aa, Medicago truncatula
MPSTEGDLDLRPSSHSAFTTGEYTFADVNNLEHCAKYLNQSLVTFGFPASLDLFSNDPVSIARTCNCIYFLLQQRQRDVEFRESANEQRQRLLSDISRYEAKVERLDGQLQAKDREIATITRTEAKNTAALKAQIEKLQKERDEFQRMVIGNQQVRTQQIHEMKKKEKEYIKLQERLNQVLMEKKKESRSGMEIMNLLQKEGRQRGTWNGKKTDNDFYKKIVDAYEVKNQELIAENADLRALLRSMQVDMRDFLNAPNGLPNQSPTTNERSESNPSHSPLVGRTDVFDLPFHMARDQIEESLRAKMASIKERMVQLQDAQKEAEVTSEATERELELEAQLVEARSIIQEQASIMSKHLAKSDRPSKLIYSLNFTGNRLRLRGSARLGAHVGVETVLMMAFSINLL

SEQ ID NO: 325 - DNA, 1197 bp, Oryza sativa
atgtccgcctcctcgcgcttcgatctccgggcctcgtcgcacccgcaccagcacgccatcggaggcggaggcggaggcggaggcatgagtgacggtggcggtggcgcggcggcggcgttcgcggacgcggggaacctcgagcactgcgccaggtacctcaaccagacgctcgtcaccttcggcttcccggcctcgctcgatctcttcgccaccgaccccgtatcgattgcgagaacgtgcaactgcatctatgctcttcttcagcagcggcagcgtgatattgagttccgggagtctaccaatgatctgcgtcagcgtatgcagtctgatatttctagattagaagccaagattgaaagaatggatgctcaattagctgcaaaagatcgcgagctggccacattgactagaacggaggccaaaaacactgcaactttgaaggctcagattgacaagctgcaacaggaacgcgatgagttccaaaaaatggttattggcaatcagcaagtacgtacccagcaaattcatgaaatgaagaaaaaagagaaagaatacatcaaattgcaggagaagttaaaccaggtattaatggagaaaaagaaggaatcatcacgttcaggaatggaaataatgaacttgttgcagaaagaaggacggcagcgtggaacttggagtggaaaaaagaatgacaatgattattacaaaatgattgttgatgcctatgaggtaaagaagcaagagttgatgcaagaaaatgctgatttgcgagcactattgcgttcgatgcagatggatatgcgcgagttcctcaatgctccaaatggagttccacagccagctgttgtgggcaatggacgacaggaggcaggatctcctcagtctccacttggtggcaagacggatgtctttgatttgccctttcacatggctagagaccagattgaagagagtttgcgcactaaaatggcttccataaaggcccgaatgacacaacttcaagatgcccaaaagggtgcagaagtgacatcagaagctaccgagcgggaacttgaacttgaagctcaactagttgaagctagaagcattatccaggagcaggcatccctcatgtccaagcactttacgaagtctgataaaccaaggaggttgagtggattggatgctgagcgtgaggcggttgcagctcaggaggtgtaa

SEQ ID NO: 326 - protein, 398 aa, Oryza sativa
MSASSRFDLRASSHPHQHAIGGGGGGGGMSDGGGGAAAAFADAGNLEHCARYLNQTLVTFGFPASLDLFATDPVSIARTCNCIYALLQQRQRDIEFRESTNDLRQRMQSDISRLEAKIERMDAQLAAKDRELATLTRTEAKNTATLKAQIDKLQQERDEFQKMVIGNQQVRTQQIHEMKKKEKEYIKLQEKLNQVLMEKKKESSRSGMEIMNLLQKEGRQRGTWSGKKNDNDYYKMIVDAYEVKKQELMQENADLRALLRSMQMDMREFLNAPNGVPQPAVVGNGRQEAGSPQSPLGGKTDVFDLPFHMARDQIEESLRTKMASIKARMTQLQDAQKGAEVTSEATERELELEAQLVEARSIIQEQASLMSKHFTKSDKPRRLSGLDAEREAVAAQEV

SEQ ID NO: 327 - DNA, 1266 bp, Physcomitrella patens
atggggttaaccgacgttgatggtggttacgggggtttatatgattctagcgacgtgtttggggatgatacttttgcagacattcacaatttggaccactgcattaagtatctcaaccagtctttagttacatttggctttccatcaggactagatctttactccagtgaaccatcttcaatcgtgcgaacatgcaactgcatatatgccatgattcagcagcgacagcgggacatcgaatatcgtgaagcagccaatgactcgaggcaaaggctaatgtcagatatgtcccggcttgaagctaaggtggaaaggcttactgatcagctggcaagtaaagaacgtgaattgcaagcaatcacaagcaaggagcaaaaagcggcagctactagcagagctcaaattgagaagctccagcatgagaaagatgagtttcaaaggatggtgattagtacacagcaagttaaagctcagcagatgcatgaactgaagaagaaagagaaagagtatatcaagttgcaggaacggttgaatcaagtattaatcgaaaagaagaaagattctaagaatggtattgagatcatgaatttattacagcagaaagagggcaggcaacgggggacttggaacaccaagaaagcagatggtgatttctataagatgatagtggatgcttatgaaacaaagaagcaagatcttgtggctgaaaatttggaattgcggggtttgcttcgatctatgcaggatgacatgcgtgattttttgaacaccccgagtgggctgattagacctggcactggagtaagctctcacgaacatgaaccacctgccacacccctgggaggccgaacggatgtattcgacctaccttttcatatggcgagagatcagattggagaaagcttacgtgctaaaatgtctaccattaaagaacgaatgatgcagctgcaagaaagtcaaaagttacttgatgcaggaagagaaactagtgagcgcgagcaagctcttgaggcgcagcttctagaggcccgcagcattatttctgaacaggctagtctaatgaacaaacacatgtcggaggaggatgacagcagtcacgtcattgcaaagttaatggagtcggaaaataaagcaagtactgcacagggcataaatttgtattttcaatcgatggtccgaatcatactgggatgttgcgaacaggaagaggagcgaatatcaaagataaagacatttgacgggacaattttatccaaggtattctaa

SEQ ID NO: 328 - protein, 421 aa, Physcomitrella patens
MGLTDVDGGYGGLYDSSDVFGDDTFADIHNLDHCIKYLNQSLVTFGFPSGLDLYSSEPSSIVRTCNCIYAMIQQRQRDIEYREAANDSRQRLMSDMSRLEAKVERLTDQLASKERELQAITSKEQKAAATSRAQIEKLQHEKDEFQRMVISTQQVKAQQMHELKKKEKEYIKLQERLNQVLIEKKKDSKNGIEIMNLLQQKEGRQRGTWNTKKADGDFYKMIVDAYETKKQDLVAENLELRGLLRSMQDDMRDFLNTPSGLIRPGTGVSSHEHEPPATPLGGRTDVFDLPFHMARDQIGESLRAKMSTIKERMMQLQESQKLLDAGRETSEREQALEAQLLEARSIISEQASLMNKHMSEEDDSSHVIAKLMESENKASTAQGINLYFQSMVRIILGCCEQEEERISKIKTFDGTILSKVF

SEQ ID NO: 329 - DNA, 1146 bp, Populus trichocarpa
atgccaacttctgatactgacttcgatctcagctcctctcccgcatctgccttctcaatcggagagtatacatttgctgatgtgaataacttggagcattgtgcaaagtacttgaaccagactcttgttacctttggtttccctgcctctcttgatcttttcgctaatgatccggtttcaaccgcccgaacctgcaactgcatttactctttgcttcaacagaggcagcgcgacgttgaatttagagaatctgccagtgagcagagacagagactactatcagatatatcgagattggaagctaaggttgagaggcttgagtcgcagttacaagccaaagatagagagatagcgacaataactagaacggaagccaaagctacagcagcttttaaggcccaaattgaaaagcttcaacaagaacgtgatgaatttcaaaggatggtaattggtaatcagcaagtgaggactcaacaaatacatgaaatgaagaaaaaagaaaaggagtacataaagttgcaggagaggctaaaccaagtgttaatggagaaaaagaaggaatcacgatcaggcatggagataatgaatttgcttcagaaagaagggcggcagcgtgggacatggaacggaaagaaggctgataatgatttctacaagaaaattgtggatgcttgtgaggctaaaaatcaagagttaatggcagagaataatgatttaagggcattgctgcggtcaatgcaggttgatatgcgtgacttcttcaatgcaccaaatgggtcatccaaacaatctccacctgccaatgagagacttgtaacagacccctcacaatctcccttgggtgggaggacggatgtgtttgacttgccttttcacatggctagagatcaaattgaagaaagtctccgaaccaagatgtcttccataaaggagcgtatggttcaactacaagatgcacagaaaggagcagaagtcacctctgaagcgactgagagagaactagagctcgaagctcaacttgttgaggcaagaagcataatccaggagcaggcatctataatgtctaagcatcttgcgaagtcagagaggccaagggaatctatcatctcttcaccagctgaggtagtacgagaccaacggggttga

SEQ ID NO: 330 - protein, 381 aa, Populus trichocarpa
MPTSDTDFDLSSSPASAFSIGEYTFADVNNLEHCAKYLNQTLVTFGFPASLDLFANDPVSTARTCNCIYSLLQQRQRDVEFRESASEQRQRLLSDISRLEAKVERLESQLQAKDREIATITRTEAKATAAFKAQIEKLQQERDEFQRMVIGNQQVRTQQIHEMKKKEKEYIKLQERLNQVLMEKKKESRSGMEIMNLLQKEGRQRGTWNGKKADNDFYKKIVDACEAKNQELMAENNDLRALLRSMQVDMRDFFNAPNGSSKQSPPANERLVTDPSQSPLGGRTDVFDLPFHMARDQIEESLRTKMSSIKERMVQLQDAQKGAEVTSEATERELELEAQLVEARSIIQEQASIMSKHLAKSERPRESIISSPAEVVRDQRG

SEQ ID NO: 331 - DNA, 1170 bp, Zea mays
atgtcctcgtcggcgcgtttcgatctccgggcctcgtcgcatcagttgcagccgccgccgtcgcacgccagcatgagcagcgacgggggcgcgttcgcaaacgcggagaacctggagcactgcgcccggtacctgaaccagacgctcgtcaccttcggattcccggcatctctcgacctcttcgccaccgatccggtctcgattgcaagaacttgtaactgcatctatgcgctgctgcagcagcgacagagggacattgagttcagggagtctacaaatgaccagcggcagcggatgcaatctgatatctcacggctggaagctaagatagagagaatggatgctcaattagcagcgaaagatcgagagctagccactcttactcgaacggaggccaaaaacactgctgctctgaagtctcagattgataagctgcaacaagaacgtgatgaatttcagaaaatggttataggaaatcagcaagtacgcacccagcaaattcatgaaatgaagaagaaagagaaagaatacataaagttgcaggaaaagctaaatcaggtattgatggagaagaaaaaggaatcatcccgttctggaatggagataatgaacttgttacagaaagaaggacgacaacgcggaacatggaatggaaaaaagaacgacaatgattattacaaaatgattgttgatgcatatgaagtgaagaaacaagagctgatgcaagagaatgcagatttacgggcactgttacgttcaatgcagatggacatgcgtgactttctcaatgccccgaatgggtcatcacaatctactgttactgataatggaagacaggagtcagggtctcctcagtctccgcttggtggcaagacggatgtttttgacttgccctttcatatggccagagatcagatagaagagagtttgcgcacaaaaatgacttcaatcaaggcacgaatgacacaacttcaagatgctcagaaaggtgcagaagtgacttctgaggcaactgaccgggagcttgagcttgaagctcaactggttgaagcaagaagcatcatccaagagcaggcctgcatcatgtccaagcacttcaagtctgataagccaagtggcaggaggcatagcggtctggatggcgagcgtgaggcatctgccgaggtgtaa

SEQ ID NO: 332 - protein, 389 aa, Zea mays
MSSSARFDLRASSHQLQPPPSHASMSSDGGAFANAENLEHCARYLNQTLVTFGFPASLDLFATDPVSIARTCNCIYALLQQRQRDIEFRESTNDQRQRMQSDISRLEAKIERMDAQLAAKDRELATLTRTEAKNTAALKSQIDKLQQERDEFQKMVIGNQQVRTQQIHEMKKKEKEYIKLQEKLNQVLMEKKKESSRSGMEIMNLLQKEGRQRGTWNGKKNDNDYYKMIVDAYEVKKQELMQENADLRALLRSMQMDMRDFLNAPNGSSQSTVTDNGRQESGSPQSPLGGKTDVFDLPFHMARDQIEESLRTKMTSIKARMTQLQDAQKGAEVTSEATDRELELEAQLVEARSIIQEQACIMSKHFKSDKPSGRRHSGLDGEREASAEV

SEQ ID NO: 333 - DNA, 519 bp, Brassica napus
atgtcgtcttcttcttcacataatattgagctggaggcagctaagtttctgcacaagctcattcaagattccaaagatgaaccttcgaagctagccacaaaactctatgtgatattgcagcacatgaaaaccagtgggaaggaacactcaatgccgtatcaagtcatatcaagggcaatggagactgtggtcagtcaacatggtcttgacattgaagctttgacgtcccctcgtcttcctcatgctggtggtagtagtacccaaatggaagattctggatctgcacatattgctggatcttctcaagtcgttggagttaacaatgagcccaaagcaagtctagttgaaaatgagacgtcaaaatatgatgcattcacttctgctaggcagcttggtggatcaaccagtgcatcacaagccgtttaccaagggcctggaactcgaagtaacagatccttcgatcatgacagtccatccagcttggattctaagccggggaaatgcccagtctcacgatag

SEQ ID NO: 334 - protein, 172 aa, Brassica napus
MSSSSSHNIELEAAKFLHKLIQDSKDEPSKLATKLYVILQHMKTSGKEHSMPYQVISRAMETVVSQHGLDIEALTSPRLPHAGGSSTQMEDSGSAHIAGSSQVVGVNNEPKASLVENETSKYDAFTSARQLGGSTSASQAVYQGPGTRSNRSFDHDSPSSLDSKPGKCPVSR

SEQ ID NO: 335 - DNA, 324 bp, Gossypium hirsutum
atggcgtcttcttcgcatcatgttgagttggaggccgcaaagtttctgcacaaactcattcaagattctaaagatgagccagtgaagctagcaactaaacttcatgtgatattgcaacatatgaaagctagtggaaaggagcattcaatgccgtttcaagtaatatcaagggcaatggagactgttatcaatcaacatggtcttgatcttgaagctttgaagtcatcacggcttcctccaacagcgggaccgcaaacattagatgctacatctggacaatattctggatcttcccagggtgttgcagtttccaaaggattctaa

SEQ ID NO: 336 - protein, 107 aa, Gossypium hirsutum
MASSSHHVELEAAKFLHKLIQDSKDEPVKLATKLHVILQHMKASGKEHSMPFQVISRAMETVINQHGLDLEALKSSRLPPTAGPQTLDATSGQYSGSSQGVAVSKGF

SEQ ID NO: 337 - DNA, 9096 bp, Glycine max
atggcctcttcacataatgttgaattggaggctgctaagtttctgcataaacttattcaagattctaaagatgaaccagccaagctggctactaaactctatgtgatactacaacacatgaaatcaagtgggaaggagcattcaatgccatatcaagtgatatcaagggcaatggagactgtcatcaaccaacacggtcttgatattgaagcattgaagtcatcacgtcttcctttgactggtggtcctcaaataggatcttcttcacagtcagtgaatgtaacaaaagattccagagtgggtttggctgaaaatgaggtgtccaaaatggacccgtttgcttcaggtcggccaccggttgccccaagtggtggagcgcctgattattatcaaggatctgtggcacagaggagtagtcagtcttttgatcaaggaagtccatctagtttggattctaggtctgctaactctcagtcacaagatagacgtgatactgccaattgggacaaacaggtgagtcaaaaggatggcaagaaagctacaacaaagagaaagaggggagatacatcatcacctgtggaactgcatgttgacagtccttctcagctggatcctcgcaatactgttaaaaatggtgaactaaccaactttaacatgactccaaatagtggtcaaatggagaatgtttcggctttgtctggtagcatgaggacaatgcttagagcaaaccaagaaggccatcatttattggcaaaacaaactgatttgacaaaggttggcaatccgatggtgcgagcacctaattcaaagtatgcagaagacactgaagtttcctctgcacatattgcttcagggaagcagcaagcacgccttagttgtgaccactttggtgcttgtctgaagtacaaccttgagggtgatggtttagtggaacaacagttaaaacagcttcgagctcagtgccttgttttcctagcatttagaaatggtctagcaccaaaaaaactacatcttgaaattgcacttggaactgccttttctagagaagatggttctcgcaaagatctaattgacctcaaaggaaaatcacaatcttttaatgaaccaggtaactcatctggggccatgatgccatttggaggtcccagcaatgccagacagacggataaaaaccttttggggtcctcttcagttggcaaaattgtggaggctgattctttgtcaaagggaactgagagcccaagaatgttggaggacaaaggtaacctacatgtcacaaaaagaggagaggttgatagacgaattcaagaaagagtggcttcacaagcttcctcagccacttcatgtcagcagcaagattcttcaagtacaaggggtgctttagttggaagatccaaccaatcttctgttgctggcccaaataactgggccggttttgctggtgctaatgaggcttcaaagggacctcctcaggtctctgctattcaacatgagttgcctatagaaagaagagagaatattcctagtcagtttcaaaatgttgagcaatggaaacctgttccagggatggacagtgatcctcatggagcaaccatgatgaaggatggaaatgtaatgataaaacatgtttctccagagcaagatgggaatgagaggttggtatcagctgattttccaccttctccaaaatatacaatgtcagagagatggatcatggatcagcagaaaaagaggcgtctactcgagcaaaattggatgctaaaacagcagaaaacaaagcaaagaatggctacaagttttcacaagttgaaggaaaatgtgagctcctctgaagatatttctgctaagaccaaaagtgtcatagagttgaaaaaacttcaactattagagcttcaacgtcgtctccggagtgattttctgaatgattttttcaaaccaattgcaaccgagatggaacatttaaaatcaattaagaaacataggcatggtaggagggtcaaacaacttgaaaggtttgagcagaaaatgaaggaagagcgtcagaagcggattcgtgagaggcagaaggagtttttcagtgagatagaggttcacaaggaaaaacttgatgatgtattcaaaatcaagagggaacggtggaagggtttcaatagatatgtgaaggagttccataaaagaaaagaacgtattcatcgtgagaagattgatagaatccagcgggaaaagattaatttactgaaaataaatgatgtggagggctatcttcgaatggtgcaggatgcaaaatcagatcgtgtaaagcaactacttaaagagaccgagaagtatcttcaaaagcttgggtccaagctacaggaagcaaagactgcagcaggacgttttgggcaggatgttgatgagacaggaaatgtcagttttcttgagaatagcgaaacagaaaatgtggatgaaagtgatcaggcaaaggcaaatatatccactacgttgcaggaaacaaattcgagaaagtgcagcagtggcacaactgaaactgctgtaacaatatgccattatatggaaagcaatgaaaagtattacaagatggctcacagtataaaggagagcattgcagagcagccatctagtttgcaaggcgggaaattgagggaatatcaaatgaatggcctgaggtggctggtttccctatacaacaatcatttgaatggaattcttgctgatgaaatgggactgggtaaaacagtacaggttatttctttaatttgctatctgatggaggcaaaaaatgatagaggaccgtttctcgtggttgtgccctcttcagttctacctggttgggactcggaaataaacttttgggctcctggtgttcataaaattgtctatgctggtccaccagaggaaaggcgtcggttattcaaggaaaggattgttcaacagaaattcaatgttcttttgactacgtatgaatatttgatgaataagcatgatagaccaaagctgagcaaaatacattggcattatataataattgatgaaggccaccgcataaagaatgcttcttgcaagttgaatgctgacttgaaacactatcagagctctcacagattgctgttaactggaacacctttacagaacaatcttgaagaactatgggcactacttaatttcttgttaccaaacatattcaattcatcagaggacttctctcaatggtttaataagccatttgagagtgctggagatagctcgcctgatgaagctttattgtccgaggaggagaatctcttgattataaatcgtctgcaccaagttttgagaccatttgtacttaggaggctgaaacacaaggttgaaaatgagttgcctgagaagattgagagactaataagatgtgaggcctcatcatatcaaaaacttttgatgaagagggtggaagaaaatcttggttctattggcaattcaaaggctcgatcagtacacaactctgtcatggagcttcgtaatatatgcaatcatccatatctcagtcagcttcatgcagaggaggtggataacttcatacctaaacattatctgccaccaattattagactttgtgggaagcttgagatgttggaccgtttattgccaaaattgaaggcgacagatcatcgggttcttttcttttcgacaatgactaggcttttggatgttatggaggaatacttaactttgaaacagtatcggtacctccggttggatgggcatacatcaggaggtgatcgtggtgctctgattgatctatttaaccaacctggttccccatattttattttcttgctcagcattcgggctggtggtgttggagtgaatcttcaggctgctgacacagttgatctgcaagctcaagcaagggctcatagaattggtcaaaagagggatgttcttgttcttcggtttgaaacggttcaaactgttgaagaacaagtcagggcttcggctgagcacaaacttggagttgctaatcagagcattactgctggttttttcgacaataatacaagtgctgaagatcgaagagaatacttggaagcactcctgcgtgagtgtaagaaagaagaggctgcacctgttttggatgatgatgctctaaacgatgtcttagcccgcagtgaatcagagttggatatatttgaggctgttgacaaaaaaaggaaggaagatgagctggctacatggaagaaattgatgcttggacaggcagctgatggttccgatattcctcaacttcctgctcgtctggtcactgatgaagacctgaaacagttctatgaagcaatgaagatatctgatgtgcctaaggctgaggtagaatctagtggagtaaagagaaagggtggatatattgggggccttgatactcaacactatggcaggggaaaacgtgctagagaggtacgttcctatgaagagcaatggacagaagaggagtttgagaagatgtgtcaggttgaaactccagattcacccaacaaagtaaaagaagtggcagaaaagagttgtccaacaaatacttccagctctgtggtatctacttctaacttacaacctgtgcctgtgcctccagcggtcccaacattgccagctgtggagagtttgccggtagtggtacagcaagttaaagagataaccccacccgccaaacgtggtcggggaagacctaaaagaataacttcagataagtcaccagctgtagtggtctctccagtaacttctggaactgttgaagtagacacacagttacagaaaggatttgggtctggacatttagcatcgtcaactcctgattctgttgctcattctgctgaagtttctgtcattcctatgcctactattccaccaaattctcaggtagctgctgttcctgtttctgtacctattcaagcaagagggcaagggaggaaaagtcatggtggggaagggattagacgtagagggaagaagcaggtcatgatttcacctgcaatccctgttggttctgttggtcctgatctaaaggttaatgataaattggaagataaattggtcagtccttcaggtcaagctatatcccagagtgaaactgttcccagctttgctgcagagccccatccaccttctgcttctttgagcagtggaaaggatcctttgggtgttggggttgttttgaattctcaagcaccccctcctttgccctctaatacaaccttggttcaaactgcacccacttatccgtccgtacagatgctaagtaaaggacaaaatcagaagtcacaaactggagtttcccgtcgtaggggaaagaaacaggcaacaatattagcaccggttccggatcttttacatcaggatttacatcaaactgctaatttgccgatttcatcaggcagtatatcaggtgaaaaagccactgaattaaagagcttgcaagagagcaatgttcaagaatcaaaatgtgttgtcctggatcaagcatcacagagcgtaggtgatcaggatttaaaatcactgggaggatcagatgattcatccaaacagacagtgatcatgtcttcatgtcaagatagtatgattaaatctccaggacaagatcttgacacggttaaaaatcctgatgctcatgattcttctgtaaaggttgttaaatcttctgaaattacctcatcgaaaattgatgaagtttgcaataactcggggaatgaaactttacttggcacaacagtgcctgttactggggtgatacaggatcaacattcaggtggtaaaactcataatcaaactgttgaaatttcaaaaaccatcccttcagttgttgatactccaattaattccttgactgacaatgaaactacacaaagcatcaacaagtctttagatcctgtgactccaacgattgttcccagtacattaactactgtttatcccacgccaggttctgaatctactcatccaggcttggctgaatccattcccaccaaaaggcaaggtcgtaaaactcaaaatagagcagagccaccacggcgtaagggaaaaaaatcagctgcagtgttacctgttgttcctgatgctgttactggtcaggatcctaagttaagtcatcatgcacaaaattcaccagtagattcattgccggggaaagccactgccaatatcactcaaacccaagcattggagatccttttacccagtggagtactacagaaagttgcatcaacaaggattgatgttttctctggaacttgcttaccaaagcctaaagctcatgattctgctgggagtgaagataggaacacacctgttgtacctgtactgactaaagctgcagtggatgtcgcttccaataaccagagtttggaggatagagcgtgttctaatatagcagctactggtgcagcatgccttgcttcaaatgttcctgtgaatgttagcgaaaaacaaccagaaatggcatccaatatggataatttggagggtaaagcaagtttagatatgccaactactggagaacatagcctgacatcagatgttaaagaaaaggctgaacagatgcaacattctgttgaaagctcaaccacgagttgtaaaatagctctagatacaactctcaatgctgtccaaaagatcgatggttcttctgagagacttccaactggctctgctctcaatgatttaaatatagatagttctagccatcagatgtgttcatcttcaggatgcccaccaactccattggaaccagacagttttagcaataatcctgtaactagtcaggctgatacctgcactcggagccattcatcctcaaacaaacctcctgataccacagaacacatttctaatgaaaaattggaacccttgcaaccatctttgaaatcttcatctcttgcttgtgttgacggctctgggttattggttcagactgaaaatttgggtgatcaaccacaagtgatcccatcatgttctgcaacagatcttcctccaatggcgatgatagtttctagtatttcagaatatactgaagttaaaaatgaaactgagtctactttaaaaccttctactgaactctcatctgatgaggggattgttgggtataaaattcctgcttctcagttgctggagcccgaggatcggattgcatttgaacataattctcaaatggcattagaaccctccacgaaacagtgtttagaatctgcttctgaaatgaaagttcctgtgagtcctaaagctgttgaagttcagaagcatccagatgcactagaacctgctgatttgcatggtactccattgattgagagttgcccaaaatctctctgtgaagaaaaaagggatgatagggtttccaaatgtgaacagcttcagtcttgtgttgttgaacctataaatattgaccctgtttcccaagaaaatatagtattatccaatcctattaacaatccaaagactgattcttccgaggcttgccatatggaaatggacacatcagacaggtcagtgttgccacaaccttcttctggtttggaagctgtagggaatgagttagtagatatttctggtgttggcagtcttttagagggaagtaaatccgaagctgcagttctgcccccgtcaaccttgatagaagaacaaaataggggatcagctgtaacatgcccagttaggagttcagaacctttggaggagtcaatggagaagggtgtggctaacaactctgcagttcaggaggaagcaaaagttgataaagtagaaactgatgttcaaatggattcttccattagtcagactttgcaagtaaaacatgaaatttttcaagcaaatgtgaatttgccctcccatctgatggcgaaggaagaaaacatagaagtctcatcctcaaggcccctatctatcagttcatctccatcacatgaattgaaggattctgaacttgaactaggtgataaatatatatctccggttggtgattttcagactgaatctaaagataatatgttgaagagcttggatttagtttcatctccttccgttaggaaggaagaagggatcagttctacatctgatattgatggttctgaaggcctttcgatgtctctgaatgttcatcaattaataactgtcccagatgctgtcgagtcttcatcgtcccaagtgaaagaggaaaaaaagattggggtatcttctgacagtaaattagttgtgaggtctgtatctgaaaatgacatggaaggatctggtcttttgccagaaaaccctgtgctggaaatcaataaaatgtcatcagattcctcaacgattgttagccactctgtggaggaaattaaaattggtgatcaaatggatgcttctcatgtctctgagaatgatttagaaaggattacttctaaatgcatggatggccctctttgcagttcccttgcttctagtgaaccaagagatcctttgattgagaatagtagagatggcatcgaggattctgttgcaaatccattaccacaacagaaatcaaaatgttctgaatctgggaaggttgatgagatgaaaacatctgatgttgtcagggttgatccaggactgaagtccaaaatcgcagattttccttcttccttagtgatggagcaagataaagctgctgcatcatatgatagcccactggctgctgcagaaccaaaatattgtttgaccggagagaattgtgaaaatgctaatgaggaaccaaatccttcagaagctgagatcggtaatgaaatgaatgcatctgatgtagctggggttaatacacagctttcatcaagtagcattattgtgccatcatcttccttgatgactgaggatgataatattgtggtgtcatctgacaatggtccacaatgcagtatgcaagtactcaaggaatcgaaagattgtcagactgaagaggggagctgtaaagatgccactgagggtccctctacaaatccagtactgctgcaggaattaattattaattctgaagctgagacatgtaatgaaggcaagacacaggttggttacccctttagactctgcgaaaaccttttatcttggttttacagtcaatag

SEQ ID NO: 338 - protein, 3031 aa, Glycine max
MASSHNVELEAAKFLHKLIQDSKDEPAKLATKLYVILQHMKSSGKEHSMPYQVISRAMETVINQHGLDIEALKSSRLPLTGGPQIGSSSQSVNVTKDSRVGLAENEVSKMDPFASGRPPVAPSGGAPDYYQGSVAQRSSQSFDQGSPSSLDSRSANSQSQDRRDTANWDKQVSQKDGKKATTKRKRGDTSSPVELHVDSPSQLDPRNTVKNGELTNFNMTPNSGQMENVSALSGSMRTMLRANQEGHHLLAKQTDLTKVGNPMVRAPNSKYAEDTEVSSAHIASGKQQARLSCDHFGACLKYNLEGDGLVEQQLKQLRAQCLVFLAFRNGLAPKKLHLEIALGTAFSREDGSRKDLIDLKGKSQSFNEPGNSSGAMMPFGGPSNARQTDKNLLGSSSVGKIVEADSLSKGTESPRMLEDKGNLHVTKRGEVDRRIQERVASQASSATSCQQQDSSSTRGALVGRSNQSSVAGPNNWAGFAGANEASKGPPQVSAIQHELPIERRENIPSQFQNVEQWKPVPGMDSDPHGATMMKDGNVMIKHVSPEQDGNERLVSADFPPSPKYTMSERWIMDQQKKRRLLEQNWMLKQQKTKQRMATSFHKLKENVSSSEDISAKTKSVIELKKLQLLELQRRLRSDFLNDFFKPIATEMEHLKSIKKHRHGRRVKQLERFEQKMKEERQKRIRERQKEFFSEIEVHKEKLDDVFKIKRERWKGFNRYVKEFHKRKERIHREKIDRIQREKINLLKINDVEGYLRMVQDAKSDRVKQLLKETEKYLQKLGSKLQEAKTAAGRFGQDVDETGNVSFLENSETENVDESDQAKANISTTLQETNSRKCSSGTTETAVTICHYMESNEKYYKMAHSIKESIAEQPSSLQGGKLREYQMNGLRWLVSLYNNHLNGILADEMGLGKTVQVISLICYLMEAKNDRGPFLVVVPSSVLPGWDSEINFWAPGVHKIVYAGPPEERRRLFKERIVQQKFNVLLTTYEYLMNKHDRPKLSKIHWHYIIIDEGHRIKNASCKLNADLKHYQSSHRLLLTGTPLQNNLEELWALLNFLLPNIFNSSEDFSQWFNKPFESAGDSSPDEALLSEEENLLIINRLHQVLRPFVLRRLKHKVENELPEKIERLIRCEASSYQKLLMKRVEENLGSIGNSKARSVHNSVMELRNICNHPYLSQLHAEEVDNFIPKHYLPPIIRLCGKLEMLDRLLPKLKATDHRVLFFSTMTRLLDVMEEYLTLKQYRYLRLDGHTSGGDRGALIDLFNQPGSPYFIFLLSIRAGGVGVNLQAADTVDLQAQARAHRIGQKRDVLVLRFETVQTVEEQVRASAEHKLGVANQSITAGFFDNNTSAEDRREYLEALLRECKKEEAAPVLDDDALNDVLARSESELDIFEAVDKKRKEDELATWKKLMLGQAADGSDIPQLPARLVTDEDLKQFYEAMKISDVPKAEVESSGVKRKGGYIGGLDTQHYGRGKRAREVRSYEEQWTEEEFEKMCQVETPDSPNKVKEVAEKSCPTNTSSSVVSTSNLQPVPVPPAVPTLPAVESLPVVVQQVKEITPPAKRGRGRPKRITSDKSPAVVVSPVTSGTVEVDTQLQKGFGSGHLASSTPDSVAHSAEVSVIPMPTIPPNSQVAAVPVSVPIQARGQGRKSHGGEGIRRRGKKQVMISPAIPVGSVGPDLKVNDKLEDKLVSPSGQAISQSETVPSFAAEPHPPSASLSSGKDPLGVGVVLNSQAPPPLPSNTTLVQTAPTYPSVQMLSKGQNQKSQTGVSRRRGKKQATILAPVPDLLHQDLHQTANLPISSGSISGEKATELKSLQESNVQESKCVVLDQASQSVGDQDLKSLGGSDDSSKQTVIMSSCQDSMIKSPGQDLDTVKNPDAHDSSVKVVKSSEITSSKIDEVCNNSGNETLLGTTVPVTGVIQDQHSGGKTHNQTVEISKTIPSVVDTPINSLTDNETTQSINKSLDPVTPTIVPSTLTTVYPTPGSESTHPGLAESIPTKRQGRKTQNRAEPPRRKGKKSAAVLPVVPDAVTGQDPKLSHHAQNSPVDSLPGKATANITQTQALEILLPSGVLQKVASTRIDVFSGTCLPKPKAHDSAGSEDRNTPVVPVLTKAAVDVASNNQSLEDRACSNIAATGAACLASNVPVNVSEKQPEMASNMDNLEGKASLDMPTTGEHSLTSDVKEKAEQMQHSVESSTTSCKIALDTTLNAVQKIDGSSERLPTGSALNDLNIDSSSHQMCSSSGCPPTPLEPDSFSNNPVTSQADTCTRSHSSSNKPPDTTEHISNEKLEPLQPSLKSSSLACVDGSGLLVQTENLGDQPQVIPSCSATDLPPMAMIVSSISEYTEVKNETESTLKPSTELSSDEGIVGYKIPASQLLEPEDRIAFEHNSQMALEPSTKQCLESASEMKVPVSPKAVEVQKHPDALEPADLHGTPLIESCPKSLCEEKRDDRVSKCEQLQSCVVEPINIDPVSQENIVLSNPINNPKTDSSEACHMEMDTSDRSVLPQPSSGLEAVGNELVDISGVGSLLEGSKSEAAVLPPSTLIEEQNRGSAVTCPVRSSEPLEESMEKGVANNSAVQEEAKVDKVETDVQMDSSISQTLQVKHEIFQANVNLPSHLMAKEENIEVSSSRPLSISSSPSHELKDSELELGDKYISPVGDFQTESKDNMLKSLDLVSSPSVRKEEGISSTSDIDGSEGLSMSLNVHQLITVPDAVESSSSQVKEEKKIGVSSDSKLVVRSVSENDMEGSGLLPENPVLEINKMSSDSSTIVSHSVEEIKIGDQMDASHVSENDLERITSKCMDGPLCSSLASSEPRDPLIENSRDGIEDSVANPLPQQKSKCSESGKVDEMKTSDVVRVDPGLKSKIADFPSSLVMEQDKAAASYDSPLAAAEPKYCLTGENCENANEEPNPSEAEIGNEMNASDVAGVNTQLSSSSIIVPSSSLMTEDDNIVVSSDNGPQCSMQVLKESKDCQTEEGSCKDATEGPSTNPVLLQELIINSEAETCNEGKTQVGYPFRLCENLLSWFYSQ

SEQ ID NO: 339 - DNA, 2259 bp, Medicago truncatula
atgaaagaacaaattgggacaaatgagatggcatctccacagaatgtcgagttggaggctgccaagtttctgcataaacttattcaagattctaaagatgagccagtcaagttggctactaaactctatgtgatactacaacatatgaaatccagcggaaaggaacattcaatgccatatcaagtgatatcaagggcaatggagactgtcatcaaccaacatggccttgatattgaagcactgaagtcgtcacgtcttcctttgactggtgttccgcagataggatcttcttcacaagcagtgggtggtgcaaaagattccagaccaagtttggctgaaagcgaggctcccaaaatggaaccctttacttctggtcgaccaccaattgccccaactggcggagctcctgattattatcaaggatctgtagctcagaggagtaatcaatcttttgatcaagaaagtccatctagtttggattctaggtctgctaactcactgtcacaagataaacgtgatactgtcatttgggacaaacaggcgaatcaaaaggatggtaagaaaggtaacacaaaaagaaagaggggtgattccacatcacctgtggaaatgcatgttgacagttcttctctagtagaacctcgcaacactggtgttaatacaaggaaggggaaaatgaccaagactgaaccatcagatggtattccagctaaaagtggtgaaatgacaaactttagcgtggttccaaataacagtcaaatggagaatatttcaactttttctggaaacatgaaaacaatgcttagggcaaacccagaaggtcatcatttattggcaaagcaaactgattcgacaaatattggcaatccaacggggcgggctccaaattcaaagtatccagaagacttggaagtttcctctgctcatattgctcctgggaagcagcaaggtgcatatgctagggttcatggagggatggtggttcctgctaatgtgtctgcaatgaacgaaccagttttctcaagttccatgcaatatggtgttcctcttaatcgtgatggggggagttcaaatactttagctgatgggcatcaaatatctcagattggcaggcaaaatagtggctcagaaatgactatgcttagacaaggtgttccccctagagatacaggaaaatccccagttcctgctgcatcatctactatgcctttcaaagaaaaccagttaaaacaacttcgagctcagtgccttgtttttctagcttttagaaatggtttaccgccaaagaaactacatcttgaagttgcatttggaaccttttttgctagagaagatggttctaataaagattcaaatgaccccaaaggaaaatcacagtcttttagtgagcctggtaacatgccaggtgtcataatgccatttggaagttcgagcaatctaagaccgactgataaaaatccttcagggtcctctgctggaaaatttttagaggctgaatcttttatgaagggaactgatggcacaagattgttagaagacaaaggtaaccttcattctgacatccagacaccttcagaagacagcaaacatcttgccgcaaaaagagatgttgagagacgaatccaagaaagagtcgctgcacaatcttcttcagctactccatatcagcagaaagattcttcaagttcaaggggtattgtagttggtaacagtaatttggatgatagtgacaatggtatcttgacggctggaagagctaaccaaccttctgttgtaggccctaataactggactggatttgctggtcctagcgaggcttcaaagggacctccacaggtctctacttctcaacatgagttacctatagaaagaagagagaatattcctactcactttcagagtgttgtcaacagtcgtggttcctggaatcccaattctgttaatcacttgacttcttattctttgaaagagcactggaaacctgttccagggattgatagcaatcaccacggaggagtaaccacgatgaatggaaatgtattgggcaaaaatgtttctgcagagcaaggaggaaatgataagttagcatcagctgatttgccatctaaaaaatttacaatgtcagagagatggattatggatcagcagaaaaagaggcttctagttcagcaaaattggatgcaaaaacagcagaaagcaaaggaaagaatgacaacatgttttcacaagttaaaggtttgcctttttattgtaacttaa

SEQ ID NO: 340 - protein, 752 aa, Medicago truncatula
MKEQIGTNEMASPQNVELEAAKFLHKLIQDSKDEPVKLATKLYVILQHMKSSGKEHSMPYQVISRAMETVINQHGLDIEALKSSRLPLTGVPQIGSSSQAVGGAKDSRPSLAESEAPKMEPFTSGRPPIAPTGGAPDYYQGSVAQRSNQSFDQESPSSLDSRSANSLSQDKRDTVIWDKQANQKDGKKGNTKRKRGDSTSPVEMHVDSSSLVEPRNTGVNTRKGKMTKTEPSDGIPAKSGEMTNFSVVPNNSQMENISTFSGNMKTMLRANPEGHHLLAKQTDSTNIGNPTGRAPNSKYPEDLEVSSAHIAPGKQQGAYARVHGGMVVPANVSAMNEPVFSSSMQYGVPLNRDGGSSNTLADGHQISQIGRQNSGSEMTMLRQGVPPRDTGKSPVPAASSTMPFKENQLKQLRAQCLVFLAFRNGLPPKKLHLEVAFGTFFAREDGSNKDSNDPKGKSQSFSEPGNMPGVIMPFGSSSNLRPTDKNPSGSSAGKFLEAESFMKGTDGTRLLEDKGNLHSDIQTPSEDSKHLAAKRDVERRIQERVAAQSSSATPYQQKDSSSSRGIVVGNSNLDDSDNGILTAGRANQPSVVGPNNWTGFAGPSEASKGPPQVSTSQHELPIERRENIPTHFQSVVNSRGSWNPNSVNHLTSYSLKEHWKPVPGIDSNHHGGVTTMNGNVLGKNVSAEQGGNDKLASADLPSKKFTMSERWIMDQQKKRLLVQQNWMQKQQKAKERMTTCFHKLKVCLFIVT

SEQ ID NO: 341 - DNA, 1437 bp, Oryza sativa
atggcctcatcccaacaagttgagcttgaggctgcaaagcttcttcagaaactcattcaagagtcaaaggatgaacctgctaaattagcaacaaaactttatgtgatatgccaacatatgaaactaagtggaaaagagcagtcactgccatatcaggtcatatcaagggccatggagactgttgtaagccaacatggaatagatatggatgcgttgcgatcatcgagaatcccattagctggtggtccacaagcaggagattctagtggtgctatgcctaaggataaggagatcattggcagtcaacctcccatggttggtactgatgcatcccaaagtagtgcgcatgctggattatggaattttccatcaggttcagcagatatggcacgtcacagtgcatctatttcaggcagggtcccagcaggaccaaataggagcgatgttgcaggagctgatattcatcaaggctccatgtcacagaagagtggaagatcctctggaatggaaagccctgccagtctgcaaatagaggatactagatctatgaattcacatgattctttgaagtcagatgaaaaaacaagcaaaaaatcatcttctaagagaaaaagagtggatccaaaagcagcaggggacttgcattctgaagacaactcaaaatcagatgccatgtctaccggacaaaatattagaaagggaaaacagcctggcaaagctggtactcagggtcaactttccaggacagtcgaacacgatccatcacatacattacaagttggtaatgctcaggtgccaccgttacccagtggtgcacctttctttagggctcaccaggaaggaccatcagcttcttctgcaaggactatagacaagactaaaccatcaaatccattcacaatggcacaaatttcaaattttgctgaaggactagcttctggcaacattcctgctgagttgcagaaaagtatattgggaggagcaaatctacttaatgctagttttggctggaaccagaatgcacaaggtccagttatgaagaatactcaagggtctgttcccaacctaatgagacctggtgttaatgtcgaagggaaagttaacttaggatcacaaggaacttttaattctatgtctgcatcacaaatggattaccccacagttcctccttatgtgtcttcttcctttggaggtggtccacagtatcttgacaaagggaaagacttgacttcaggcaatactggcagtgaactaaattcttctaaagctggagctcagctggggatcatgcattccaatgcaagaaaggcacggaattgtcagagcacctcagagagctggttcatctcaaatgtctcaaacctctcccagcattccattcaaagagcagcagttgaagcagctcagagcgcagtgcttagtatttcttgcatttag

SEQ ID NO: 342 - protein, 478 aa, Oryza sativa
MASSQQVELEAAKLLQKLIQESKDEPAKLATKLYVICQHMKLSGKEQSLPYQVISRAMETVVSQHGIDMDALRSSRIPLAGGPQAGDSSGAMPKDKEIIGSQPPMVGTDASQSSAHAGLWNFPSGSADMARHSASISGRVPAGPNRSDVAGADIHQGSMSQKSGRSSGMESPASLQIEDTRSMNSHDSLKSDEKTSKKSSSKRKRVDPKAAGDLHSEDNSKSDAMSTGQNIRKGKQPGKAGTQGQLSRTVEHDPSHTLQVGNAQVPPLPSGAPFFRAHQEGPSASSARTIDKTKPSNPFTMAQISNFAEGLASGNIPAELQKSILGGANLLNASFGWNQNAQGPVMKNTQGSVPNLMRPGVNVEGKVNLGSQGTFNSMSASQMDYPTVPPYVSSSFGGGPQYLDKGKDLTSGNTGSELNSSKAGAQLGIMHSNARKARNCQSTSESWFISNVSNLSQHSIQRAAVEAAQSAVLSISCI

SEQ ID NO: 343 - DNA, 729 bp, Populus trichocarpa
atggcgtcttcacaatcttcacaaaatgtggagttggaggctgctaagtttctacacaaactcattcaagattctaaagatgagcccgcgaaactggctacaaaactctatgtgattttgcaacacatgaaatcaagcgggaaggaacattccatgccgtatcaagtaatatcaagggccatggagactgtcatcaatcagcatggtcttgatattgaagctttgaggtcatcacgccttcctttgaccggtggaactcaaatgggggattcttcgactgcacaatatggaggatcttcacaggcagttggagttgggaaagactctaaagctggattggctgaaaatgagatatccaaagttgatccttctgcttccagtaggccccctgctggcccaagtagtgcaggccatgattattatcaaggatctggaactcaaaggagcagccagtcatttgatcatgaaagtccttctagtttggaaactaggtctgccaattcacaatcccaagaaagaggagcgaatcagaaggatggtaaaaaggctgttgctaagaggaagaggggtgattcatctttacacttggaaatgcatgttgagaatccccaacaacttgatcctcgcaataccatagttaatccaaggaaggggaaaatgaacaaggttgactcaccagggagttatgcagttagaggtgcaagggggttctctttcatctgcacatga

SEQ ID NO: 344 - protein, 242 aa, Populus trichocarpa
MASSQSSQNVELEAAKFLHKLIQDSKDEPAKLATKLYVILQHMKSSGKEHSMPYQVISRAMETVINQHGLDIEALRSSRLPLTGGTQMGDSSTAQYGGSSQAVGVGKDSKAGLAENEISKVDPSASSRPPAGPSSAGHDYYQGSGTQRSSQSFDHESPSSLETRSANSQSQERGANQKDGKKAVAKRKRGDSSLHLEMHVENPQQLDPRNTIVNPRKGKMNKVDSPGSYAVRGARGFSFICT

SEQ ID NO: 345 - DNA, 417 bp, Zea mays
atggcttcatctcagcatgttgagatggaggctgcgaaacttctacataaacttattcaggagtcgaaggatgagcctgctaaactagcaacaaaactttatgtgatatgtcagcatatgaaactaagtggaaaggagcaatcactgccatatcaagtcatatcaagggctatggagacagttgtgaaccaacatggaattgatatggatgcattgcgatcatcacgaattccatttgctggtggtcctcaggcaggggattctagtggcgtcatgtcaaaggacaaggaggtcattggtaaccagtctcccatggtcggaagtgatgcttcccaaagtagtggacaatttggattatggcagcttccatcaggttcaaccgatatgataagacatgggggcatctatttcaggtag

SEQ ID NO: 346 - protein, 138 aa, Zea mays
MASSQHVEMEAAKLLHKLIQESKDEPAKLATKLYVICQHMKLSGKEQSLPYQVISRAMETVVNQHGIDMDALRSSRIPFAGGPQAGDSSGVMSKDKEVIGNQSPMVGSDASQSSGQFGLWQLPSGSTDMIRHGGIYFR

SEQ ID NO: 347 - DNA, 6453 bp, Glycine max
atgcagtcatttcaacagcaactgcttagaaaacctgaagggagtgaagcatttttggcatatcaagctggtcttcaaggagtatttgggagtaacaatttcccatctagttccatgcagttacctcagcaatctcgaaaatttgttgatttagctcagcatggctccaaccaggttcaaggtgttgagcagcaaatgctaaatcctgtacaagcagcatactttcagtatgctctgcaggcttcgcaacaaaagtctgctttggcaatgcagtcacagcagcaacctaaagtgggaatgctgggcccttcatctgtaaaggatcaggaaatgagaatgggaaatttgaaaatgcaggatcttatgtccatgcaggcagtgaatcaggtccaagcatcatcatctagaaattcatctgaacattttacttggggggaaaagcgggtagagcaagggcagcagctagcacctgatcagaagagtgaaggaaattcttcaagccagggaccagctgttggaaacttaatgcctggaaatattataagacctgtgcaagctctggcaactcagcagagcatcccgaacactatgaacaaccagattgcaatggctgctcagttgcgggctatgcaagcatgggcacatgaacgaaatattgatctgtcacatcctgcaaatgctaacttaatggctcagctcattccactgatgcaatcaaggatagttcaacaaccaaaggcaaacgatactaacttaggtgcaatgtcatcacctgtccctgtttcaaaccaacaggttacttctccggcagtcgcaagtgagagttcagcacatgctaattcatctagtgatgtgtctgcacaatctggttctgcaaaagccaggcagacggctccacccagccatttgagtccaccaattagtgctggtatagccagtagctctagtgacatggcagcacagcaattcagtcttcatggcagagacgctcaaggatctttgaagcaatcagttctaaccataaatggaatgccttctgtgcatccacagcagtcctctgcaaacatgaacttaggtgcagatcatcctctgaatgtaaaaacttcatcatctggttcagaaccagcgaaaatgcagtacatcagacaactaagccaatctacttctcaggctggaggtctgacaaatgaaggtggatcaggaaatcaccccaaaactcaggggggaccatctcagatgcctcaacaacgaaatggttttaccaaacaacagcttcatgttcttaaggcacaaatactagcatttaggcgtctgaagaaagcagaaggtgcactcccccaagaacttcttcgggccatcattccaccacctcttgatttgcaagtgcagcagccaattcattctgaaggagcacaaaatcaggagaaatctgctggaaatattgtggcagaacacccgaggcagaatgaggtcaatgccaaagattcacagcctatctcatccattaatggaaagaactcttcaaaacaggaagtctttgtcagagatgagaactccactgtaacggcagttcaggtgcaaggcacacctcgtgtgacaaaggaatctgctggaaaggaagagcagcagtctgttgcatgctctgctaagtcagatcaggaaagtgaacatggaattggcagaactcctgttagaaatgagttagtattagataagggaaaagctgttgctgctccccaggcttcagtaaatgacgcaatgcaactcaataaacctgcacaagcaagtgctgtttcccagacaaaggatgtgggatccaccagaaaatatcatggacccctatttgattttcctttcttcaccagaaaacatgattcgtttgggtcatcaatgatgatcaacaacaataatttgtcattggcatatgatgtgaaagagcttctttttgaggaaggcatagaggtccttggcaagagaaggacagagagtttaaagaagattgaaggtttattggcggtaaacttggagaggaaaagaattaggccagatcttgtgttgaggttgcaaattgaagagaaaaaacttcgccttttagatcttcaggcacgtttaagggatgagattgatcaacagcaacaagagataatggcaatgccagataggccataccgcaagtttgttaggttatgtgaacgtcagcgtatggaacttgctagacaagtgcaggcatctcagagagctttaagggagaagcaactgaaatctatatttcaatggcgcaagaagcttcttgaaacacactgggccattcgtgatgcccgtactgctcgcaacaggggggtggccaaatatcatgaaaggatgttgagagagttctcaaaacgtaaggatgatgaccgaaataaaaggatggaagccttaaaaaataatgatgttgacagatatagggagatgttgctggagcagcagactagcatccaaggtgatgctgcagagagatatgctgttctttcaactttcttaacccagactgaagagtatctccataaattaggaagtaagataactgctgctaagaatcaacaggaaggtctttctgaagaagaagtcagagcggcagcagcctgtgctggagaggaagtgatgattagaaatcgttttatggagatgaatgctcctaaagacaattcatctgtcagcaagtattacagccttgctcatgctgtgagtgagaaggttgtatgccaaccatcaatgttacgggcaggaacactaagagactatcaacttgttggtttgcaatggatgctttccttgtataacaacaaattaaatggaattttggcagatgagatgggtcttggcaaaactgtacaggttatggcattaattgcatacttgatggagtttaaaggaaactatggcccacatcttataatagtcccaaatgctgttatggttaactggaagagtgagttgtatacttggctaccgtctgtgtcatgcattttttatgctggagggaaggattaccgatcaaaattatattcacaagagattatggctatgaaatttaatgtcctggtgactacttatgagttcatcatgtatgaccgggcaaggctttcaaaaattgattggaagtatatcataattgatgaagcacagagaatgaaggatagagattcagttctagctcgtgatcttgatagatatcgttgtcaaaggcgcctgcttctgacaggaacacctttgcagaatgatttgaaggaactgtggtcgcttttaaatttacttcttccagaggtttttgacaataagaaagcctttaacgattggttttcaaagccatttcaaaaggaaggtcccactcaaaatacagaggatgattggcttgagactgagaaaaaagttatcattatccaccgtcttcatcagattcttgagcctttcatgctcaggcgtcgtgttgaagatgttgagggttcactaccaccaaaggtctctatagttttacgatgtaagatgtcagctgtccagagtgccatttatgactgggtcaaatcaactggtacccttcgtcttgatcctgagggtgagaacagtaagattcaaaagaatcctcattaccaggcaaaagagtacaagactttaaataacagatgtatggagctacgtaaaacttgcaatcatccatctctgaattacccattacttggtgaattatctacaaattcaattgtaaaatcttgtgggaaattgtggatcctggataggatccttataaagcttcaaagaactggtcatcgggttttgctgtttagtaccatgacaaaacttctagacctcttggaagactacctgaattggcgaagacttgtgtacagaagaattgatgggacaactaatttggatgaccgtgaatcggccataatggactttaatagccctgattccgactgtttcatcttcttgcttagtattcgagctgccgggagaggccttaaccttcagtctgctgacacagttgtcatttatgatcctgacccaaaccctaaaaatgaggagcaggctgtggccagagctcatcgtattggacagaaaagagaagtcagagttatctacatggaagctgttgttgacaaaatctctagccatcagaaggaagatgaattgagaagtggaggcactgttgatatggaggatgaacttgtgggtaaggatcgctatataggatccattgagagcctcataaggaacaatattcaacaatataagatagatatggccgatgaggttatcaatgctggacgtttcgatcaaaggacaacacatgaagagaggcgtttgaccttagagacattgttacatgatgaagaacggtatcaagaaaatgtccatgatgttccttctcttcaggaggtaaatcgcatgattgctaggagtgaagaggaagttgaattgtttgatcaaatggatgaagaactggattggcctgaggacgtgatgcaacatgatgaggttcctgagtggctccgagccaatacaagagaagtgaatgctgctattgctgctttatctaaaagaccatcaaagaacactttattgggtggtagtattggcatggaatccagtgaggtgggttctgaaaggagaaggggacggcccaagggaaaaaagcatcctaattataaagagttggaagatgaaaatggagagtattctgaagcaaattctgaagacagaaatgaagattctgcacaagaaggggaaaatggagagtttgaagatgatgggtatagtggggctgatggaaatcgattggaagaggatggtctaacttctgatgctggatatgaaattgccctttcttcagaaaatgctagaaataatcatgtggttgaagaagctggttcctcaggatcatcctccgacagtcaaagattgacaaagacagtttcaccatcagtttcttccaaaaaatttggctccctctctgcattggatgccaggccaggctccatttcgaaaattatgggagatgagttagaggaaggggaaattgtagtatctggtgattctcacatggatcatcaacagtcaggtagttggattcatgatcgtgatgaaggtgaagatgaacaagttttgcagaaaccaaagattaagcgtaagcgtagtcttcgtgttcgtccccgccatgccatggaaaggcccgaggacaagtctggcagtgagatgatttctcttcaacgtggagaatcatctgttttggcagattataaatatcaaattcaaaaaaggattgatccagaatcaaaatcttttggagactccaatgccagcaagcatgataagaatgaagcatcactaaaaaataagcaaaagttaccttcaaggaaaatagctaattcatccaaattgcatggatcacctaagtctaatcgtttgaattgcacatctgctccttcagaggatggcaatgaacaccccacagaaagttgggaggggaagcatctcaatccaaatggatcttcagctcatgggactaagacaaccgaaatcatccagagaggatgcaaaaatgtaattagcaagctccaaaggagaatagacaaggaaggccatcaaattgtacctttgctaacagatttgtggaagaggatggagaattctgggcatgcaggtggatctgggaacaatctgttggatttacggaagattgaccagcggattgatagaatggattatagcggagtaatggagcttgtgtttgatgtacagttcatgttgaggggtgcaatgcatttctatggatactcatatgaggtaagaactgaaggaaggaaggtccatgatctcttctttgatattttgaaaattgcgtttccggatacagactttggagaagcaagaggtgcactatctttctccagccaagctcctgccggtactgcagcatccccaaggcaagggacagttggccctagcaaaaggcacagaatgaccaatgatgcggaaactgatccatgcccttcacaaaagctgtcacaaagcggatcaacttctaatggcgaaaatgccaggttcaaaggtcatttgccacagaagaactcaagaaccggaagcagcagtgcacgtgaacaacctcagcaggataaccctccactgcttgctcatccaggtcaattggttgtgtgcaagaagaaaagaaatgacagggacaaatcattggggaagggtaggactggatcaactggtcctatttctccacctagtgctataagaagtccagggtcaggttcaaccccaaaggatgctagactggctcaacagggaaggggtagccagccatctcaacactcaaatgggtctggtgggtcagttggttgggcaaaccctgtaaagcgtttgagaacagattctggtaagaggagaccaagccatatgtag

SEQ ID NO: 348 - protein, 2150 aa, Glycine max
MQSFQQQLLRKPEGSEAFLAYQAGLQGVFGSNNFPSSSMQLPQQSRKFVDLAQHGSNQVQGVEQQMLNPVQAAYFQYALQASQQKSALAMQSQQQPKVGMLGPSSVKDQEMRMGNLKMQDLMSMQAVNQVQASSSRNSSEHFTWGEKRVEQGQQLAPDQKSEGNSSSQGPAVGNLMPGNIIRPVQALATQQSIPNTMNNQIAMAAQLRAMQAWAHERNIDLSHPANANLMAQLIPLMQSRIVQQPKANDTNLGAMSSPVPVSNQQVTSPAVASESSAHANSSSDVSAQSGSAKARQTAPPSHLSPPISAGIASSSSDMAAQQFSLHGRDAQGSLKQSVLTINGMPSVHPQQSSANMNLGADHPLNVKTSSSGSEPAKMQYIRQLSQSTSQAGGLTNEGGSGNHPKTQGGPSQMPQQRNGFTKQQLHVLKAQILAFRRLKKAEGALPQELLRAIIPPPLDLQVQQPIHSEGAQNQEKSAGNIVAEHPRQNEVNAKDSQPISSINGKNSSKQEVFVRDENSTVTAVQVQGTPRVTKESAGKEEQQSVACSAKSDQESEHGIGRTPVRNELVLDKGKAVAAPQASVNDAMQLNKPAQASAVSQTKDVGSTRKYHGPLFDFPFFTRKHDSFGSSMMINNNNLSLAYDVKELLFEEGIEVLGKRRTESLKKIEGLLAVNLERKRIRPDLVLRLQIEEKKLRLLDLQARLRDEIDQQQQEIMAMPDRPYRKFVRLCERQRMELARQVQASQRALREKQLKSIFQWRKKLLETHWAIRDARTARNRGVAKYHERMLREFSKRKDDDRNKRMEALKNNDVDRYREMLLEQQTSIQGDAAERYAVLSTFLTQTEEYLHKLGSKITAAKNQQEGLSEEEVRAAAACAGEEVMIRNRFMEMNAPKDNSSVSKYYSLAHAVSEKVVCQPSMLRAGTLRDYQLVGLQWMLSLYNNKLNGILADEMGLGKTVQVMALIAYLMEFKGNYGPHLIIVPNAVMVNWKSELYTWLPSVSCIFYAGGKDYRSKLYSQEIMAMKFNVLVTTYEFIMYDRARLSKIDWKYIIIDEAQRMKDRDSVLARDLDRYRCQRRLLLTGTPLQNDLKELWSLLNLLLPEVFDNKKAFNDWFSKPFQKEGPTQNTEDDWLETEKKVIIIHRLHQILEPFMLRRRVEDVEGSLPPKVSIVLRCKMSAVQSAIYDWVKSTGTLRLDPEGENSKIQKNPHYQAKEYKTLNNRCMELRKTCNHPSLNYPLLGELSTNSIVKSCGKLWILDRILIKLQRTGHRVLLFSTMTKLLDLLEDYLNWRRLVYRRIDGTTNLDDRESAIMDFNSPDSDCFIFLLSIRAAGRGLNLQSADTVVIYDPDPNPKNEEQAVARAHRIGQKREVRVIYMEAVVDKISSHQKEDELRSGGTVDMEDELVGKDRYIGSIESLIRNNIQQYKIDMADEVINAGRFDQRTTHEERRLTLETLLHDEERYQENVHDVPSLQEVNRMIARSEEEVELFDQMDEELDWPEDVMQHDEVPEWLRANTREVNAAIAALSKRPSKNTLLGGSIGMESSEVGSERRRGRPKGKKHPNYKELEDENGEYSEANSEDRNEDSAQEGENGEFEDDGYSGADGNRLEEDGLTSDAGYEIALSSENARNNHVVEEAGSSGSSSDSQRLTKTVSPSVSSKKFGSLSALDARPGSISKIMGDELEEGEIVVSGDSHMDHQQSGSWIHDRDEGEDEQVLQKPKIKRKRSLRVRPRHAMERPEDKSGSEMISLQRGESSVLADYKYQIQKRIDPESKSFGDSNASKHDKNEASLKNKQKLPSRKIANSSKLHGSPKSNRLNCTSAPSEDGNEHPTESWEGKHLNPNGSSAHGTKTTEIIQRGCKNVISKLQRRIDKEGHQIVPLLTDLWKRMENSGHAGGSGNNLLDLRKIDQRIDRMDYSGVMELVFDVQFMLRGAMHFYGYSYEVRTEGRKVHDLFFDILKIAFPDTDFGEARGALSFSSQAPAGTAASPRQGTVGPSKRHRMTNDAETDPCPSQKLSQSGSTSNGENARFKGHLPQKNSRTGSSSAREQPQQDNPPLLAHPGQLVVCKKKRNDRDKSLGKGRTGSTGPISPPSAIRSPGSGSTPKDARLAQQGRGSQPSQHSNGSGGSVGWANPVKRLRTDSGKRRPSHM

SEQ ID NO: 349 - DNA, 6675 bp, Medicago truncatula
atgcaatctaacggcggcgccggcgatgggcctggccggaactcggcggggcgggcagcgtcgacgtcgtcagcggctgcgtcgccgacttcttcgtcttcggcggcttcccacatgggattggactcattgcagcagcaacagcagatgataggtggttctagacagtcatttcaacagcaactgcttagaaaatctgaagggagtgaagcggtgctggcgtatcaagcagggcatcaaggattatttgggaataacaattactcatcttccactgccatgcaattgcctccgcagtctcgaaatttttttgctttagctcagcatggacctaaccagggtcaaggcattgagcagcagaggctaaatcctgtccgacaggcgtactctcagtatgctctccagagttttcaacaaagacctgctttggcaatgcagtctcagcagcaacctaaaatggagatgttaggccccacatctgttaaggatcaagaaatgcgaatgggaaattttaagttgcaggaccttatgtctatgcaggcagtgaatcatggccaaggatcgtcatcttctaggaattcatctgaacatttttcacatggtgaaaagcgggtagagcaaggacagcagctagcttctgataagaagaatgaaggaaagtcctcaactcagggactaggcattggacacttgatgcccgggaataatataaggcctgtgcaagcactgccgactcaacagagcatcccaattgctatgaacaatcagattgcaacctctgatcaactccgagctatgcaggcatgggcacatgaacggaatattgatctatcacaacctgcaaatgctaactttgcggctcagctcaacttgatgcaaacaaggatggttcaacaatcaaaggaaagtggtgctcagtcatcttctgtcccagtttcaaagcagcaggctacttctccggcagtttcaagtgagggctctgctcatgctaattcatctactgatgtttctgcactggtaggttctgtgaaagccaggcagacagctccacccagccatttgggcttacccatcaatgctggtgtggctggaaactccagtgacacggcagtgcagcaattcagtcttcatggtagagatgctcaaggatctttgaagcaattgattgtaggtgtaaatggaatgccttctatgcatccacaacagtcttctgcaaacaagagcttaggcgcagatagttctttgaatgcaaaagcttcatcatctagatctgatccagaacctgcaaaaatgcagtatgtcaggcaattaagccaacatgcttccctggatggagggtcgacaaaggaagtgggctctggaaattacgccaaacctcaagggggaccatctcagatgcctcaaaaactaaatggctttaccaaaaatcagcttcatgttcttaaagcacaaatactagcatttaggcggctgaagaaaggtgatggtatacttccccaagaacttcttgaggccattagtccaccacctcttgatttgcatgtgcagcagccaattcactctgcaggagcacagaatcaagataaatctatgggaaatagtgtgacagaacaaccaaggcagaacgaacccaaggccaaggattcacaacccatcgtatcttttgatggaaattcttcagagcaggaaacttttgtaagagatcaaaagtcaactggagcagaagttcatatgcaagctatgcttcctgtgacaaaggtctctgctggaaaggaagaccagcaatccgctggattctctgctaagtcagacaagaaaagtgaacatgtgattaacagagctcctgttataaatgatttggcattagataagggaaaggctgtcgcttcccaggctttggtaactgacactgcacagattaataaacctgcacagtcaagcactgttgttggcctgccaaaggatgcaggacccgcaaaaaaatattatgggcccctatttgattttcctttcttcactaggaaacaagattcctttggatcatcaatgatggcaaacaacaacaacaatttgtctctggcatatgatgtaaaagagcttctttatgaggaaggcacagaagtctttaacaagagaagaactgagaatttaaagaagattgaaggattacttgcggtaaacttagagaggaaaagaattaggccagatcttgtgttgaagttgcaaattgaagagaaaaagcttcgccttttagatctccaggcacgtttaagaggtgagattgatcaacagcaacaggagataatggcaatgccagacaggccatatcgcaagtttgttaagctgtgtgaacgtcagcgtgtggaactcgctagacaagtgcagacatctcagaaagctttaagggagaagcaactgaaatctatattccaatggcgcaagaagcttcttgaagttcactgggccattcgtgatgctcgtactgctcgcaatagaggggtggccaaatatcacgagaagatgttgaaagaattctcaaaaaataaggatgatgacaggaataagagaatggaagccttaaaaaacaatgatgttgacagatatagggagatgttgctggagcaacagactagccttccaggggatgctgcggagagatacaatgtactttcaactttcttaacccagactgaagagtatctacaaaaattaggaagtaagataacttctgccaaaaatcaacaggaagtagaggagtcggcaaaagccgcagcagctgctgcacgattgcagggtctttctgaagaagaagtcagagctgcagcagcttgtgctggagaggaagtgatgattagaaatcgttttatggagatgaatgctccaaaagatggctcgtcttctgtcagcaagtattacaaccttgctcatgccgtgaatgaaaaagttttaaggcaaccatcgatgttgcgggctggaacactgagagagtatcagctcgttggattgcaatggatgctttctttgtataacaacaaattaaatggaattttggctgatgagatgggtcttggcaaaacagtccaggttatggcgttaattgcctacttaatggaatttaaaggaaactatggcccacatcttataatagttccaaatgctgttttggttaactggaagagtgaattgcatacatggttaccatcggtgtcatgcattttttatgttggatcgaaggatcatcggtcaaaattattttctcaagaggttatggctatgaaatttaatgtccttgtgactacttatgagttcatcatgtatgaccgttcaaagctttctaaaattgattggaggtatgtcataattgatgaagctcagagaatgaaggatagagagtcagttttagctcgtgatcttgatagatatcggtgtcacagacgcctgcttctgacaggaacacctttacagaatgatttgaaggagctttggtcacttttaaatctacttcttcctgaggtttttgacaataagaaagccttcaatgattggttctcgaaaccatttcaaaaggaagatcccaaccaaaatgcagagaatgattggcttgaaacagagaagaaagttatcattatccatcggcttcatcagattcttgagcctttcatgctcaggcgtcgtgttgaagaggttgaaggctcgctaccaccaaaggtatctatagttttacggtgtagaatgtcagccttccagagtgccatttatgactggattaaatccactggaactcttcgtcttaatcctgaggaggagcaaagtcggatggaaaaaagtccactctaccaggcaaagcagtataaaactttaaataacagatgcatggagctgcgtaaaacttgcaaccatccattgcttaattacccattctttagtgatttatctaaagattttatggtaaaatgttgtgggaaattgtggatgctggatagaattctcataaaacttcaaagaacaggacatcgagttcttctgtttagtaccatgacaaaactcctagacatattggaagagtacctgcaatggcgaagacttgtttacagaagaattgatgggacaacagctttggaagaccgcgaatcagctatagtggacttcaatagccctaattcagactgtttcatcttccttcttagtattcgggctgctgggagaggccttaaccttcagtcagctgacacagttgttatttatgaccccgacccaaaccctaaaaatgaggagcaggctgtggccagagctcatcgcattggacaaaaaagagaagtcaaagtcatctacatggaagctgttgttgacaaaatctctagtcatcagaaggaggatgaaatgagaattggaggcactattgatatggaggatgagcttgcaggtaaggatcgatatataggatccattgagagcctcataaggagcaatattcagcaatataagatagatatggctgatgaggttattaatgctggacgttttgatcaaaggacaacacatgaagagagacgtttgactttggagacattattgcatgatgaagaaaggtgccaagaaactgtccacgatgttccttcgttgcaggaggtaaatcgcatgattgctaggaatgaagaggaagttgaattgtttgatcaaatggatgaagaagaggattggcttgaggagatgactcggtatgatcaggtacctgattggattcgagccagtacaagagaagtgaatgctgctattgctgcttcatcaaaaagaccatcaaagaagaatgctttatcgggtggtaatgttgtcttggactccactgaaattggttctgaaaggagaaggggacgaccaaagggaaaaaagaatccaagttataaagagttggaagattcctctgaagaaatatctgaagacagaaatgaagattctgcacatgatgaaggggagataggagagtttgaagatgatgggtatagtggggctggtatagcgcaacccgtagataaagataagttggatgatgttactccttctgatgctgaatatgaatgtcccaggtcttcttcagaaagtgctagaaataataatgtggttgaaggtggttcctcagcatcatccgcaggcgttcaaagattgacacaagcagtgtcgccatcagtttcttctcagaaatttgcttccctgtctgcgctggatgccaagccaagttcgatctcaaaaaagatgggagatgagttagaggaaggggaaattgcagtatctggtgaatctcacatgtatcatcaacagtcgggaagttggattcatgatcgtgatgaaggtgaggaagaacaagttttgcagaaacccaagattaaacgtaaacgtagtcttcgtgttcggcctcgtcacaccatggaaaagcctgaggataagtctggcagtgagatggcatctcttcaacgtggacaatcatttcttttaccagacaaaaaatatccattgcaatcaaggatcaaccaagaatcaaaaacatttggagattccagttccaacaagcatgacaagaatgaaccaatattaaaaaataagcgaaatttacctgcaaggaaagtagctaatgcatccaaattacatgtctcaccgaagtccagtcgtttgaattgcacatccgctccttcagaagacaatgatgagcactctagagaaagattgaaggggaagcctaacaatttacgtggatcttcagctcatgtcactaatatgactgaaattatccagagacggtgcaaaagtgtaattagcaagctccaaaggagaatagacaaggaaggccatcaaattgtacctttgctgacagatttatggaagaggattgagaattctgggttcgctggtggttctgggaacaatctcttggatttaagaaagattgaccagcgaatcaatagattggagtacagtggagtaatggagtttgtttttgatgtgcaattcatgttgaagagtgcaatgcagttctatgggtactcgtacgaggtaagaactgaagcaaggaaagttcatgatctcttctttgacatcttgaaaaccacattttccgacattgacttcggagaagcgaaaagtgcactttcctttactagtcaaatttctgccaatgctggagcatcctcaaagcaagcgactgtttttccaagtaagaggaagagagggaaaaatgatatggagactgatccaacccctacacaaaagccactgcaacgtggatccacttccaacagcgaaagtggcaggatcaaagtccaattgcctcagaaggcatcaagaactggaagtggtagcggcagtgccagggagcaacttcaacaggatagtccttcactgcttactcacccaggtgacctagttgtatgcaagaagaaaaggaatgagaggggggataaatcatcggtgaagcataggatcggttcagctggtcctgtttcaccacctaagattgttgttcatactgtacttgctgagagaagtccaactccagggtcaggttctacccctagggctggccatgcacatacatcaaatgggtctggcgggtcagttggatgggcgaaccccgtgaagcggatgagaacagattcagggaaaaggagaccaagccatatgtag

SEQ ID NO: 350 - protein, 2224 aa, Medicago truncatula
MQSNGGAGDGPGRNSAGRAASTSSAAASPTSSSSAASHMGLDSLQQQQQMIGGSRQSFQQQLLRKSEGSEAVLAYQAGHQGLFGNNNYSSSTAMQLPPQSRNFFALAQHGPNQGQGIEQQRLNPVRQAYSQYALQSFQQRPALAMQSQQQPKMEMLGPTSVKDQEMRMGNFKLQDLMSMQAVNHGQGSSSSRNSSEHFSHGEKRVEQGQQLASDKKNEGKSSTQGLGIGHLMPGNNIRPVQALPTQQSIPIAMNNQIATSDQLRAMQAWAHERNIDLSQPANANFAAQLNLMQTRMVQQSKESGAQSSSVPVSKQQATSPAVSSEGSAHANSSTDVSALVGSVKARQTAPPSHLGLPINAGVAGNSSDTAVQQFSLHGRDAQGSLKQLIVGVNGMPSMHPQQSSANKSLGADSSLNAKASSSRSDPEPAKMQYVRQLSQHASLDGGSTKEVGSGNYAKPQGGPSQMPQKLNGFTKNQLHVLKAQILAFRRLKKGDGILPQELLEAISPPPLDLHVQQPIHSAGAQNQDKSMGNSVTEQPRQNEPKAKDSQPIVSFDGNSSEQETFVRDQKSTGAEVHMQAMLPVTKVSAGKEDQQSAGFSAKSDKKSEHVINRAPVINDLALDKGKAVASQALVTDTAQINKPAQSSTVVGLPKDAGPAKKYYGPLFDFPFFTRKQDSFGSSMMANNNNNLSLAYDVKELLYEEGTEVFNKRRTENLKKIEGLLAVNLERKRIRPDLVLKLQIEEKKLRLLDLQARLRGEIDQQQQEIMAMPDRPYRKFVKLCERQRVELARQVQTSQKALREKQLKSIFQWRKKLLEVHWAIRDARTARNRGVAKYHEKMLKEFSKNKDDDRNKRMEALKNNDVDRYREMLLEQQTSLPGDAAERYNVLSTFLTQTEEYLQKLGSKITSAKNQQEVEESAKAAAAAARLQGLSEEEVRAAAACAGEEVMIRNRFMEMNAPKDGSSSVSKYYNLAHAVNEKVLRQPSMLRAGTLREYQLVGLQWMLSLYNNKLNGILADEMGLGKTVQVMALIAYLMEFKGNYGPHLIIVPNAVLVNWKSELHTWLPSVSCIFYVGSKDHRSKLFSQEVMAMKFNVLVTTYEFIMYDRSKLSKIDWRYVIIDEAQRMKDRESVLARDLDRYRCHRRLLLTGTPLQNDLKELWSLLNLLLPEVFDNKKAFNDWFSKPFQKEDPNQNAENDWLETEKKVIIIHRLHQILEPFMLRRRVEEVEGSLPPKVSIVLRCRMSAFQSAIYDWIKSTGTLRLNPEEEQSRMEKSPLYQAKQYKTLNNRCMELRKTCNHPLLNYPFFSDLSKDFMVKCCGKLWMLDRILIKLQRTGHRVLLFSTMTKLLDILEEYLQWRRLVYRRIDGTTALEDRESAIVDFNSPNSDCFIFLLSIRAAGRGLNLQSADTVVIYDPDPNPKNEEQAVARAHRIGQKREVKVIYMEAVVDKISSHQKEDEMRIGGTIDMEDELAGKDRYIGSIESLIRSNIQQYKIDMADEVINAGRFDQRTTHEERRLTLETLLHDEERCQETVHDVPSLQEVNRMIARNEEEVELFDQMDEEEDWLEEMTRYDQVPDWIRASTREVNAAIAASSKRPSKKNALSGGNVVLDSTEIGSERRRGRPKGKKNPSYKELEDSSEEISEDRNEDSAHDEGEIGEFEDDGYSGAGIAQPVDKDKLDDVTPSDAEYECPRSSSESARNNNVVEGGSSASSAGVQRLTQAVSPSVSSQKFASLSALDAKPSSISKKMGDELEEGEIAVSGESHMYHQQSGSWIHDRDEGEEEQVLQKPKIKRKRSLRVRPRHTMEKPEDKSGSEMASLQRGQSFLLPDKKYPLQSRINQESKTFGDSSSNKHDKNEPILKNKRNLPARKVANASKLHVSPKSSRLNCTSAPSEDNDEHSRERLKGKPNNLRGSSAHVTNMTEIIQRRCKSVISKLQRRIDKEGHQIVPLLTDLWKRIENSGFAGGSGNNLLDLRKIDQRINRLEYSGVMEFVFDVQFMLKSAMQFYGYSYEVRTEARKVHDLFFDILKTTFSDIDFGEAKSALSFTSQISANAGASSKQATVFPSKRKRGKNDMETDPTPTQKPLQRGSTSNSESGRIKVQLPQKASRTGSGSGSAREQLQQDSPSLLTHPGDLVVCKKKRNERGDKSSVKHRIGSAGPVSPPKIVVHTVLAERSPTPGSGSTPRAGHAHTSNGSGGSVGWANPVKRMRTDSGKRRPSHM

SEQ ID NO: 351 - DNA, 6519 bp, Populus trichocarpa
atgcaggcattacagcaacaattacttagaaaacccgaagggaatgaaacccttctagcttatcaagctggaactcttcaaggagttacgggagggaacaattttgcttcatctccaggctcaatgcaaatacctcaacagtccaggcaattatttgatttggctcgacaacatggttcctctcaggacggacagaataggaatcaaggtgttgagcaacaggctttgaacccaattcaacaagcatatcttcaatatgctttccaggccgcccaacaaaagtcagctttggcaatgcagtctcagcaacaagctaaagtaggaacactgggctctcctgctggaaaggatcatgacatgcgggtgggaaatttgaaaatgcaggaactcatgtccatgcagtcggcaaatcaggctcaggcttcatcttctaagaacccatctgaacatttttctcgtggtgaaaaacaggtggaacaaggtcagcagcaagcctctgaacagaggaatgagcaaaagtctccaatccagcctactgccattggacaactaatgcctgcaaatgttactagacccatgcaggcaccacaggttcagcaaaacatccaaaacatggcaaacaaccagctcacaatggctgctcagatgcaagcaatgcaagcatgggcacttgagcgcaacattgatctggcacaacctgcaaatgccaacttgatggcgaagcttattccagtcatgcaggcaaggatggctgcacaactaaaggcaaatgaaaataatactagtggacaatcatcacatctccctgtgtcaaagccacaggttgcttctccatccattgcaaacgagagttctcctcatgcaaattcatccagtgatatctctgggcagtctggctctgtaaaaaccaggcaaactgttccatctggtccctttggctcaacttccagtggaggcatagtgaataaccctaacaacctcacaatgcagcagcaggcttttcacagcagagagaaccaagcacctcctcgacaggcagttgtgcttggaaatggaatgcctgcaaacgcaagccaaggtgcagatcatactctgccttcaaaaaatgcattaaacagctcagaaacttcacagacacagcaattcaggcagctgaatcgatcttctccacaatctgctggtccttctaatgacggaggcttgggcaaccacttctcttcacaaggcaggccagctgtccagatggcacaacagcgcactgggttcactaaacagcagttgcatgttctgaaggctcaaattctagcatttaggcgactgaagaaaggagaaggtactcttccacaagagcttcttcgagctattgctccaccaccccttgagttgcagctgcagcaacaacttctccctgcaggaggaagtaatctggacaggtcgggtggaaagattgctgaagaccaagcaaggcatctggagtccaatgataagggttcgaaagcaatgctatctatgaacggacagaatttttctaaagaggaagtttttactggtgatgagaaagcaaccgtctcaaccatgcatatgcaaaaggcaccggctgtgatgaaggaacccactccccttgtggcttctgggaaagaagagcagcaaactgctacatgttctgtcaattcagaccaggagactgaacatggacttctgaaaactcctgttagaagtgatctagcagcagataggggaaggggcgttgcttcacagtttcctgcatctgatgctatgcaagctaagaaacctgcacaagcaagcactgtggtccagccgaaagataccggctctgccagaaagtatcatggaccattatttgattttcccttttttactaggaaacatgactctgttgggtcaactgggatgattaacacgaataataacctaacattgacctatgatgtcaaagatcttctttttgaggaaggcatggaaatgcttaacaagaaaaggtcagagaatttgaagaaaatcaatggtctactagcagtaaatttagagaggaaaaggattagaccagatcttgtgttgcggttacagattgaagagagaaagcttaggcttttggatctacaggcgcgtttaagggatgacgttgatcaacagcaacaggaaatcatggcaatgcctgacagactatataggaagtttgttcggctatgtgagcgtcaacggatggagctgacaaggcaggtacaggcctctcaaaaagccataagagagaagcaattgaaatccatcatgcagtggcgcaagaaacttcttgagactcattgggccatccgggatgcacgtactgcccgtaacagaggagttgctaaataccatgagagaatgttgagggagttttcaaagagaagggatgatgaccgaaataaaaggatggaggcattgaagaacaacgatgttgaaaggtatagagaaatgttgttggagcaacagactagcatctcaggcgatgcttctgagagatatgccgttctctcgtcattcttgactcagacagaagaatatctccataagctgggagaagaagaagtacgagcagctgcagcttgtgctggtgaggaagtattgataagaaaccggtttgtggaaatgaatgcaccctgggacagttcatctgttaacaaatattacaatcttgcacatgctgtgaatgaaagggtcataaggcaaccatctatgttacgagttggaaccttacgagactatcagcttgttgggttgcagtggatgctttctttgtataacaacaaattaaatggaatcttggcagatgagatggggcttggaaagactgtacaggtgatggcattgattgcttatctaatggaattcaaaggaaactatggaccacatcttataatcgttcctaatgctgttttggtgaattggaagagcgagctacacaactggctgccatctgtgtcctgcatttattatgttggtggaaaggatcagcggtcaaaattattttcccaagaggtttctgccatgaaatttaatgtccttgtgacaacttatgagttcatcatgtatgaccggtcaaaactttctaaagttgattggaagtacatcataattgacgaggcacagagaatgaaggacagggagtcagttttagcccgtgatcttgatagatatcgctgccagaggcgcttacttctcacagggacaccactacagaatgacttgaaggagctatggtcgctcttgaatctacttctgccagaagtttttgataatcgtaaagcatttcatgattggttctcaaagcccttccaaaaggaagctccaatgcatgatggagaggatgactggcttgaaactgaaaagaaggtgatcataattcatcgacttcatcaaattctagagccttttatgctcagacgtcgtgttcaagacgtggaaggttcacttccacccaagagtacaatttatgattggatcaaatctactggcactattcgagttgaccctgaggatgagaagctcagggctcaaaaaaatccagcataccagcctaaggtgtacaaaactttaaataacagatgtatggagctccgaaaaacttgcaatcatcctttgcttaattacccatatttcaatgacttatccaaggatttccttgttcaatcttgtgggaaactatggattctggataggattctcataaaacttcaaagaacaggccatcgggtactactctttagtaccatgacaaaactccttgatatattggaggaatacttgcaatggcgccgactggtatacagaaggattgatggaacaactagccttgaagatcgtgaatcggctatcgtggactttaatagccatgattcagactgctttattttcttgcttagtattcgtgctgctggaaggggtcttaatcttcagtcagctgacacagttatcatatatgatcctgatccaaaccctaagaacgaggaacaggcagttgctagagcccaccggattggacagacaagagaagtcaaagtcatttatatggaagcagttgttgacaaaatttctagctgtcaaaaagaggatgaattaagaagtggaggcaccgttgatttagaagatgaccttgttggtaaggatcgatatatgggttctattgagagcctaataaggaaaaacatccagcaatataagattgacatggctgatgaggttatcaatgctgggcgttttgatcaaagaacaacacatgaggagaggcgaatgactttagagacattattgcatgatgaggagcggtatcaagaaactatgcatgatgttccatcactccaagaggttaatcgcatgatagccaggagtaaagatgaagttgaattatttgatcaaatggatgaagagtttgattggacggaggagatgacgaggtatgatcaggtacctaaatggcttcgagccagttcaaaagaagtggatggtactattgctattctatcaaagaaaccatcaaaagctatcctttttgctgatgttatgggtatggtttccggtgaaatggaaactgaaagaaaacgggtgcggccaaaggggaaaaagtctcctaattacaaggaaatcgatgatgaaaatggagactattctgaggcaagttctgacgagagaaacggttattctgcacatgaagaagagggagaaattcaagaaattgaagatgatgaatccagtgatgctgttggggcaccgcccattaataaggaccaatcagaagatgatggtcccccgtgtgatggtgggtatgagtgtcacggagctttggaaagcactagaaataatgatgtactagatgaagctggttcctcaggatcatcctctgacagccaaagagttacacgaatgatctctcctgtctctcctcagaaattcgggtcactttctgcattagatgctagaccaggttcacttcccaaaaagctgccagatgaattagaagagggggaaattgccgtgtctggagattctcacgtggatcaccagcaatctggaagttggatgcatgatcgcgatgaaggtgaagatgaacaggttctgcaacctaagattaaacgaaaacgtagtattcggcttcgaccccgtcacactgttgaaaggccagaggagaagtctagcaatgatgtgcaacgtggagattcttgtttgttgccattccaaatggatcataaatatcaagcacagttgaggagcgatactgaaatgaaagcattagtagagcctagtggattcaagcatgatcagattgattcctcaacaagtaggcgaaatttaccttcaagaagaatagccaaaacacctaagttacatgcttcgccaaaatctggcagattgcatttgcagtctgctccagcagaggatgctactgaacactccagagtgagtctggatggtaaagttccaagtacaagtggtacttcatctttgggcaccaagatgtctgatgtcatccagagaaggtgtaagaatgttattggcaagttccaaaggaggatagacaaggaaggacaacaaattgtacctcttctagctgatttgtggaagaggattgaaaattctggtcacgtaagtggtgctggaactaatcttttggatttacggaagattgaacagcgtgttgacagattggagtatagtggagtgatggagcttgtgtttgacgtgcaattcatgttaaagggtgcaatgcaattttatgggttctcacatgaggttagaactgaagcaagaaaggtgcatgatctcttttttgatatcttgaagattgcatttccagacaccgatttccgagaggccaggaacgctctatctttctctggcccatcatcaacttccgtttctgctccgtctgcaaaacaagctgctcttggcctaagcaagagaaacaagtcaataaataatgtggaacctgacaacagcactacccataagccaatgcagcgaggatccattcctaatagtgaagacattaggagcgtccgtgtgccccagaaggaaacaagggttgggagtggaagtggcagtagtagggaacaatatcatcaggatgattctccactgcatccaggggagttagttatctgcaagaagaagaggaaagaccgggacaagtcagcagtgaggtcaaggactggatcaagtggtccagtctccccccctagcatgggccgtaatatcacgagtcctgttttgaattcaatacctaaagatgcgagactgaacactagtcctgttttgaattcaatacctaaagatgcgagactgaatactagtcctgttttgaattcaatacctaaagatgcgagactgagccagcagaatacgcatcagcaagggtgggtgaaccaaccacaaccaccaaatggtggtgcggggagtgttggttgggcaaatcctgtaaagaggttgaggacagatgctggtaaaagaaggccgagccatttatga

SEQ ID NO: 352 - protein, 2172 aa, Populus trichocarpa
MQALQQQLLRKPEGNETLLAYQAGTLQGVTGGNNFASSPGSMQIPQQSRQLFDLARQHGSSQDGQNRNQGVEQQALNPIQQAYLQYAFQAAQQKSALAMQSQQQAKVGTLGSPAGKDHDMRVGNLKMQELMSMQSANQAQASSSKNPSEHFSRGEKQVEQGQQQASEQRNEQKSPIQPTAIGQLMPANVTRPMQAPQVQQNIQNMANNQLTMAAQMQAMQAWALERNIDLAQPANANLMAKLIPVMQARMAAQLKANENNTSGQSSHLPVSKPQVASPSIANESSPHANSSSDISGQSGSVKTRQTVPSGPFGSTSSGGIVNNPNNLTMQQQAFHSRENQAPPRQAVVLGNGMPANASQGADHTLPSKNALNSSETSQTQQFRQLNRSSPQSAGPSNDGGLGNHFSSQGRPAVQMAQQRTGFTKQQLHVLKAQILAFRRLKKGEGTLPQELLRAIAPPPLELQLQQQLLPAGGSNLDRSGGKIAEDQARHLESNDKGSKAMLSMNGQNFSKEEVFTGDEKATVSTMHMQKAPAVMKEPTPLVASGKEEQQTATCSVNSDQETEHGLLKTPVRSDLAADRGRGVASQFPASDAMQAKKPAQASTVVQPKDTGSARKYHGPLFDFPFFTRKHDSVGSTGMINTNNNLTLTYDVKDLLFEEGMEMLNKKRSENLKKINGLLAVNLERKRIRPDLVLRLQIEERKLRLLDLQARLRDDVDQQQQEIMAMPDRLYRKFVRLCERQRMELTRQVQASQKAIREKQLKSIMQWRKKLLETHWAIRDARTARNRGVAKYHERMLREFSKRRDDDRNKRMEALKNNDVERYREMLLEQQTSISGDASERYAVLSSFLTQTEEYLHKLGEEEVRAAAACAGEEVLIRNRFVEMNAPWDSSSVNKYYNLAHAVNERVIRQPSMLRVGTLRDYQLVGLQWMLSLYNNKLNGILADEMGLGKTVQVMALIAYLMEFKGNYGPHLIIVPNAVLVNWKSELHNWLPSVSCIYYVGGKDQRSKLFSQEVSAMKFNVLVTTYEFIMYDRSKLSKVDWKYIIIDEAQRMKDRESVLARDLDRYRCQRRLLLTGTPLQNDLKELWSLLNLLLPEVFDNRKAFHDWFSKPFQKEAPMHDGEDDWLETEKKVIIIHRLHQILEPFMLRRRVQDVEGSLPPKSTIYDWIKSTGTIRVDPEDEKLRAQKNPAYQPKVYKTLNNRCMELRKTCNHPLLNYPYFNDLSKDFLVQSCGKLWILDRILIKLQRTGHRVLLFSTMTKLLDILEEYLQWRRLVYRRIDGTTSLEDRESAIVDFNSHDSDCFIFLLSIRAAGRGLNLQSADTVIIYDPDPNPKNEEQAVARAHRIGQTREVKVIYMEAVVDKISSCQKEDELRSGGTVDLEDDLVGKDRYMGSIESLIRKNIQQYKIDMADEVINAGRFDQRTTHEERRMTLETLLHDEERYQETMHDVPSLQEVNRMIARSKDEVELFDQMDEEFDWTEEMTRYDQVPKWLRASSKEVDGTIAILSKKPSKAILFADVMGMVSGEMETERKRVRPKGKKSPNYKEIDDENGDYSEASSDERNGYSAHEEEGEIQEIEDDESSDAVGAPPINKDQSEDDGPPCDGGYECHGALESTRNNDVLDEAGSSGSSSDSQRVTRMISPVSPQKFGSLSALDARPGSLPKKLPDELEEGEIAVSGDSHVDHQQSGSWMHDRDEGEDEQVLQPKIKRKRSIRLRPRHTVERPEEKSSNDVQRGDSCLLPFQMDHKYQAQLRSDTEMKALVEPSGFKHDQIDSSTSRRNLPSRRIAKTPKLHASPKSGRLHLQSAPAEDATEHSRVSLDGKVPSTSGTSSLGTKMSDVIQRRCKNVIGKFQRRIDKEGQQIVPLLADLWKRIENSGHVSGAGTNLLDLRKIEQRVDRLEYSGVMELVFDVQFMLKGAMQFYGFSHEVRTEARKVHDLFFDILKIAFPDTDFREARNALSFSGPSSTSVSAPSAKQAALGLSKRNKSINNVEPDNSTTHKPMQRGSIPNSEDIRSVRVPQKETRVGSGSGSSREQYHQDDSPLHPGELVICKKKRKDRDKSAVRSRTGSSGPVSPPSMGRNITSPVLNSIPKDARLNTSPVLNSIPKDARLNTSPVLNSIPKDARLSQQNTHQQGWVNQPQPPNGGAGSVGWANPVKRLRTDAGKRRPSHL

SEQ ID NO: 353 - DNA, 1593 bp, Brassica napus
atgtctctgagacccaacgccaggaccgaggttcgccgtaaccgctacaaagtggcggtggacgcagaggaaggacgcaggaggagggaagacaacatggtggagatccgtaagaccaagcgcgaagagagcttactgaagaagcgtcgcgaggggcttcaagccacgcagctgcctcaagtcacttctgctgcttcatccgtcgagaaaaagttggagagcttgccttctatggtcggtggagtctggtcagatgataggagcttgcagcttgaagccactactcagttccgtaaattgctttctatagagcgtagtcctccgatagaagaggtgattgatgctggtgttgtgccaaggtttgtggagtttctcatgagggaggattatccacagcttcagtttgaagctgcttgggcactgacgaacattgcttctgggacttctgagcatacgaaggttgtcattcaacatgatgctgttcccatttttgttcagctcctggcttcccagagtgatgatgtccgtgagcaggctgtttgggcattagggaacgttgctggtgattctccacagtgcagagatcttgtactgagtaagggagctttgttaccattgctctctcagttgaatgagcatgctaaactctccatgctcagaaatgctacttggaccctctctaatttctgcaggggcaagccacagcctccttttgaccaggttcgtccagcacttccagcccttgagcgccttattcattcgactgatgaggaagtgttaacggatgcctgttgggctctctcttatctttctgatggcacaaatgacaaaatccaatctgtcatcgaggcaggtgttgttcctcgacttgtcgagcttctccagcatccgtcaccgtctgtgcttatacccgctcttcgtagtattggtaacatcgtcactggagacgatgcgcagacgcagtgtgtaattagtcatggtgcactcctttgtcttctgagtcttctgactcagaatcataagaagagcattaaaaaggaagcatgctggacaatctcaaacatcactgctggaaacagggaccagattcaggctgtatgtgaagctggtttgatcggtcctctcatcaatctgcttcaaaatgctgagttcgatataaagaaagaagctgcatgggcagtctcaaatgccacttcgggcggttctgctgaccagatcaagtacatggtggatcagggagtcgtgaaaccactgtgcgatcttttggtatgcccggatccaaggattatcaccgtgtgtctagaaggactagagaacattctgaaagtcggggaagctgagaaggtgacgggaaacacaggggatgcaaactattatgcacagctaatcgatgatgctgagggactagagaagattgagaatctgcagagtcatgacaacagcgagatatatgagaaggcagtgaagattcttgaaacatactggttggaggaggaagacgagactttaccacctggtgatgaatctgctcagggattccagtttgggggtagcgatgcagccgcacctccaggtggattcaacttcaagtga

SEQ ID NO: 354 - protein, 530 aa, Brassica napus
MSLRPNARTEVRRNRYKVAVDAEEGRRRREDNMVEIRKTKREESLLKKRREGLQATQLPQVTSAASSVEKKLESLPSMVGGVWSDDRSLQLEATTQFRKLLSIERSPPIEEVIDAGVVPRFVEFLMREDYPQLQFEAAWALTNIASGTSEHTKVVIQHDAVPIFVQLLASQSDDVREQAVWALGNVAGDSPQCRDLVLSKGALLPLLSQLNEHAKLSMLRNATWTLSNFCRGKPQPPFDQVRPALPALERLIHSTDEEVLTDACWALSYLSDGTNDKIQSVIEAGVVPRLVELLQHPSPSVLIPALRSIGNIVTGDDAQTQCVISHGALLCLLSLLTQNHKKSIKKEACWTISNITAGNRDQIQAVCEAGLIGPLINLLQNAEFDIKKEAAWAVSNATSGGSADQIKYMVDQGVVKPLCDLLVCPDPRIITVCLEGLENILKVGEAEKVTGNTGDANYYAQLIDDAEGLEKIENLQSHDNSEIYEKAVKILETYWLEEEDETLPPGDESAQGFQFGGSDAAAPPGGFNFK

SEQ ID NO: 355 - DNA, 957 bp, Gossypium hirsutum
  misc_feature (653)..(653): n is a, c, g, or t
  misc_feature (737)..(737): n is a, c, g, or t
atgtctcttagaccgagcgcgaggaccgaggttcgacggaaccgatacaaggtggcggttgatgcggaggaaggtcggcggaggagagaagacaacatggtggagatccggaagaacaagagagaagagaaccttctaaaaaagcgtcgcgaaggacttcttgctcaacaaccgcaaccgcagcaacagcagatgttatcttccggcgttggttccgagaataagttagaaagtcttccggctatggttgtgggcgtttggtctgatgacaagaatgcacagcttgaggcaaccactcaattccgaaagctgctatcaatagaacgtagtcctccaatcaatgaagttgtacaagcaggtgttgttcctcgctttgttgagttccttaatagggatgacttccctcagcttcagttcgaggcagcttgggctctcacaaatattgcttcaggaacatcagacaataccagagttgtaattgatcatggagctgtccctatatttgttaaactcctagattctccaacggatgacgtacgcgaacaggctgtttgggcattggggaatgttgctggagactctcctaaatgccgtgacctggtccttggccatgggggcttagtgcctcttttggcacaatttaatgagcatgncaagctctctatgttgcgaaatgctacctggactttgtcaaacttctgcaggggcaaggcacaaccttcgtttgagcagacaangccagcttttgcagctcttgagcggcttatcaattcaaatgatgaggaagtcttgacagatgcatgctgggctctgtcttatctctcagacggtactaatgacaaaatccaagctgttattgaagcagggggatgcccacaacttattgagctctttgctcctccatcccccacgggtcctcattcctgccctttcccaaagttgggaataattggttaa

SEQ ID NO: 356 - protein, 318 aa, Gossypium hirsutum
  misc_feature (218)..(218): Xaa can be any naturally occurring amino acid
  misc_feature (246)..(246): Xaa can be any naturally occurring amino acid
MSLRPSARTEVRRNRYKVAVDAEEGRRRREDNMVEIRKNKREENLLKKRREGLLAQQPQPQQQQMLSSGVGSENKLESLPAMVVGVWSDDKNAQLEATTQFRKLLSIERSPPINEVVQAGVVPRFVEFLNRDDFPQLQFEAAWALTNIASGTSDNTRVVIDHGAVPIFVKLLDSPTDDVREQAVWALGNVAGDSPKCRDLVLGHGGLVPLLAQFNEHXKLSMLRNATWTLSNFCRGKAQPSFEQTXPAFAALERLINSNDEEVLTDACWALSYLSDGTNDKIQAVIEAGGCPQLIELFAPPSPTGPHSCPFPKLGIIG

SEQ ID NO: 357 - DNA, 1593 bp, Glycine max
atgtcgctcaggccaaatgccagaaccgagattcgccgcaaccgttacaaggtcgccgtcgacgccgacgagggccgccggagaagagaggacaacatggtcgagatccgcaagagcaagcgcgaagagagtttgctcaagaagcgtcgtgaaggcctccaagctcagcaacagtttcccgctcctcttcagaactccaccgtcgacaagaagctggagagtcttcctgccatggttgctggagtttggtcggatgataatagtattcaacttgaagccactacgcaatttcgcaagctgctttcgattgaacggagccctccgattgaggaagttattcaagctggtgttgttccacgttttgttgagtttcttgttagagaggatttccctcaacttcagtttgaggctgcgtgggctctcacaaacattgcatctgggacttctgagaacactaaggtggtaattgatcatggggcagttcctatatttgtcaagctacttagttcacctagtgatgatgttcgggagcaggcagtgtgggctttgggaaatgttgctggtgactcccctaggtgtagagatctagtgctcagccaaggtgccctcgtcccactgttggcccagttgaatgagcatgcaaaactttcaatgctgagaaatgccacatggacattatctaacttttgcaggggtaagccacagcctccgtttgagcaggtgagaccggcacttccagcactcgagcgtttggttttttccaatgatgaagaagttttgacagatgcttgctgggcattatcatatctctctgatggcacaaatgacaaaatccaagcagttattgaggcaggtgtatgtgccagattggtgcagcttctcatacacccatctccctcagtgctgattcctgctcttcgtacagtgggaaatattgtgactggagatgatatgcagactcagtgtattatcaatcatggtgcactcccctgccttttgaacctgttgacaaataatcataaaaaaagcattaagaaagaagcttgttggactatatcaaacattactgctggaaataaagaacagatacagactgttattgaagctggtctggttgcaccccttgtcaatcttcttcaaaatgcggaatttgacattaaaaaggaagctgcttgggcaatctcaaatgctacatctggtggaattcatgagcagatcaagtacttggtgagtcagggttgcataaagcctctttgtgatcttcttgtttgcccagacccaagaattgttactgtctgtttagaaggcctagagaatattctgaaggttggagaagctgagaagagcctaggtaacactggagatgttaacgagtatgcacagatgatagatgatgctgagggattggagaagattgaaaacctacagagtcatgacaacaatgaaatatatgaaaaggctgttaaaattcttgaaacatattggttggaagaagaagatgagacactaccttcaggagatggtgctcaacctggtttcaatttcggaaacaatgagcttccagtcccatctggtggattcaacttcagctga

SEQ ID NO: 358 - protein, 530 aa, Glycine max
MSLRPNARTEIRRNRYKVAVDADEGRRRREDNMVEIRKSKREESLLKKRREGLQAQQQFPAPLQNSTVDKKLESLPAMVAGVWSDDNSIQLEATTQFRKLLSIERSPPIEEVIQAGVVPRFVEFLVREDFPQLQFEAAWALTNIASGTSENTKVVIDHGAVPIFVKLLSSPSDDVREQAVWALGNVAGDSPRCRDLVLSQGALVPLLAQLNEHAKLSMLRNATWTLSNFCRGKPQPPFEQVRPALPALERLVFSNDEEVLTDACWALSYLSDGTNDKIQAVIEAGVCARLVQLLIHPSPSVLIPALRTVGNIVTGDDMQTQCIINHGALPCLLNLLTNNHKKSIKKEACWTISNITAGNKEQIQTVIEAGLVAPLVNLLQNAEFDIKKEAAWAISNATSGGIHEQIKYLVSQGCIKPLCDLLVCPDPRIVTVCLEGLENILKVGEAEKSLGNTGDVNEYAQMIDDAEGLEKIENLQSHDNNEIYEKAVKILETYWLEEEDETLPSGDGAQPGFNFGNNELPVPSGGFNFS

SEQ ID NO: 359 - DNA, 1575 bp, Hordeum vulgare; identical to SEQ ID NO: 235

SEQ ID NO: 360 - protein, 524 aa, Hordeum vulgare; identical to SEQ ID NO: 236

SEQ ID NO: 361 - DNA, 1686 bp, Medicago truncatula; identical to SEQ ID NO: 237

SEQ ID NO: 362 - protein, 561 aa, Medicago truncatula; identical to SEQ ID NO: 238

SEQ ID NO: 363 - DNA, 1581 bp, Oryza sativa
atgtcgctgcgcccgagcgagcgggtggaggtgcggcggaaccgctacaaggtggcggtggacgccgaggaggggaggcggcggcgcgaggacaacatggtggagatccgcaagagccgccgcgaggagagcctcctcaagaagcgccgcgaggggctccaggcccaggcccccgtccccgcctccgccgcaaccggcgtcgataagaagctcgaaagccttcctgctatgattggtggagtttattcggacgataacaaccttcagcttgaggccacaacacagttccgcaagttgctttctatagagaggagccctccaattgaagaggttattcaatcaggcgttgttcctagattcgtgcagtttcttaccagagaggatttcccccagctacagttcgaagctgcgtgggcacttacaaacattgcatctggcacttcggagaatacaaaggttgtcattgatcatggggctgtaccaatatttgtgaagcttcttggttcttctagtgatgatgttcgtgagcaggctgtatgggcattgggcaatgttgctggtgattcccctaagtgccgtgaccttgttcttgccaatggtgcattgctgcctctgctagcacagttgaatgagcacactaaactctctatgctaaggaatgcaacttggactttatcgaacttctgcagaggaaaaccacagccatcatttgaacagactaggcctgctcttccagcactggcacggcttattcactccaatgatgaggaagttctcactgatgcgtgctgggctctttcatatttatctgatggcactaatgacaagatccaagccgtgattgaagctggtgtttgcccccgtcttgtggagcttctcctccatccatcaccttcagtgcttatacccgcactacgaactgttggaaatattgtaactggagatgacgcgcaaactcagtgcatcattgatcatcaagccctcccttgcctcctaagtctgttgacacaaaatctcaagaaaagcatcaagaaagaggcttgctggactatttcaaatattactgctggtaacaaagatcagatacaggctgtcataaatgctggcattattggtcctctggtgaatctgctccaaacggcagagttcgatatcaagaaggaagctgcatgggccatctcaaatgctacttcaggcggtagccatgatcaaatcaagtatctggtgagcgagggctgcatcaagccattgtgtgatcttcttatttgcccagatataagaatcgttacagtttgtttggagggtctcgagaacattcttaaagtaggagaaaccgacaagaccttggctgcaggtgatgtgaatgtcttttcccagatgattgatgaagcggaaggtttggaaaagattgagaacttgcagagccatgataacaatgagatctatgaaaaagctgtgaagattcttgaggcctactggatggatgaggaggatgatacaatgggagctaccacggtagctgctccccaaggtgctacttttgactttggccaaggcggtggtgctgctcaattcaaataa

SEQ ID NO: 364 - protein, 526 aa, Oryza sativa
MSLRPSERVEVRRNRYKVAVDAEEGRRRREDNMVEIRKSRREESLLKKRREGLQAQAPVPASAATGVDKKLESLPAMIGGVYSDDNNLQLEATTQFRKLLSIERSPPIEEVIQSGVVPRFVQFLTREDFPQLQFEAAWALTNIASGTSENTKVVIDHGAVPIFVKLLGSSSDDVREQAVWALGNVAGDSPKCRDLVLANGALLPLLAQLNEHTKLSMLRNATWTLSNFCRGKPQPSFEQTRPALPALARLIHSNDEEVLTDACWALSYLSDGTNDKIQAVIEAGVCPRLVELLLHPSPSVLIPALRTVGNIVTGDDAQTQCIIDHQALPCLLSLLTQNLKKSIKKEACWTISNITAGNKDQIQAVINAGIIGPLVNLLQTAEFDIKKEAAWAISNATSGGSHDQIKYLVSEGCIKPLCDLLICPDIRIVTVCLEGLENILKVGETDKTLAAGDVNVFSQMIDEAEGLEKIENLQSHDNNEIYEKAVKILEAYWMDEEDDTMGATTVAAPQGATFDFGQGGGAAQFK

SEQ ID NO: 365 - DNA, 1599 bp, Physcomitrella patens
atgtctcttcgaccgaacgcccgagtggaaggtcgcaagaaggggtacaaactcgcggtcgatgccgatgaggcgcgcaggaagagggaggacaatatggtggagattcggaagagcaagagggaggagagtttattgaagaagcggagggatggtatgccgcagctgccgcagtttgtcccgtccgctcagagctctctgtctgacaagaagcaacttgagagccttccagcgttggtttctggtctttactctgacgatcctgctacccagttggaagcaaccacacaatttcgaaagcttctgtctatcgagcggagtcctcccattgaagaagtgatttccgctggtgtcgtcccccgtttcgtggagtttctagtcaggagcgattttccgcagttgcagttcgaggcggcatgggctttgacaaatattgcatcagggacttctgatcacacacgtgttgtcatcgaccatggtgctgttcccatctttgttcagctcctaagctctcccagtgacgatgtccgagaacaggctgtatgggctttgggaaacgttgctggtgattcgccgaaatgccgtgaccttgttttaggtcatggggccttgatgcctctgcttgcgcagcttacggagaacacaaaattgtctatgcttagaaacgctacctggactctctccaacttctgtcgtggcaagcctcaaccaccttttgagcagtcgaaaccagcgcttccggccttggagcggctcattcactcaaacgatgaagaggttctcacggatgcttgctgggcactatcttatttatccgatgggacgaatgacaagattcaggccgtgattgaggctggcgtctgtcgtcgacttgtggagttattgctccatccatcgccctctgtactcattcccgcgctgcgtactgttggcaacattgtgactggtgacgatcttcagacacagttcatcatcaataatcaggcccttccctgtcttcttgctcttctgaccaacaatcacaagaaaagtatcaagaaagaagcctgttggactatttccaatataactgcaggaaacaaggatcaaatccaggctgttattgatgccaacatcattccacctttggtatctcttcttgccaccgcagaatttgacatcaagaaggaagctgcttgggctatttcaaatgccacttctggtggcagtcacgatcagataaagtaccttgttacccaaggttgcattaagccactatgtgaccttctaacatgtccagatccgagaatcgtcactgtgtccctcgaagggctggaaaacattttgaaggttggggagcaggagaaagatcttggccagagtggtggtatcaacctttatgcccgctacatcgatgaagccgagggtttggagaagattgagaacttgcagacacacgataacaacgagatttatgaaaaggctgtgaagattctggagacttattggctagaagaggatgaggattcgaatgcggcacctggcacggaaggccaaaccttcgcgtttggttcaagcaacgctgcaggcgctcctgccggtggcttccactttggctaa

SEQ ID NO: 366 - protein, 532 aa, Physcomitrella patens
MSLRPNARVEGRKKGYKLAVDADEARRKREDNMVEIRKSKREESLLKKRRDGMPQLPQFVPSAQSSLSDKKQLESLPALVSGLYSDDPATQLEATTQFRKLLSIERSPPIEEVISAGVVPRFVEFLVRSDFPQLQFEAAWALTNIASGTSDHTRVVIDHGAVPIFVQLLSSPSDDVREQAVWALGNVAGDSPKCRDLVLGHGALMPLLAQLTENTKLSMLRNATWTLSNFCRGKPQPPFEQSKPALPALERLIHSNDEEVLTDACWALSYLSDGTNDKIQAVIEAGVCRRLVELLLHPSPSVLIPALRTVGNIVTGDDLQTQFIINNQALPCLLALLTNNHKKSIKKEACWTISNITAGNKDQIQAVIDANIIPPLVSLLATAEFDIKKEAAWAISNATSGGSHDQIKYLVTQGCIKPLCDLLTCPDPRIVTVSLEGLENILKVGEQEKDLGQSGGINLYARYIDEAEGLEKIENLQTHDNNEIYEKAVKILETYWLEEDEDSNAAPGTEGQTFAFGSSNAAGAPAGGFHFG

SEQ ID NO: 367 - DNA, 1590 bp, Populus trichocarpa
atgtcgttgagacctagcgcgagaaccgaggttcgccggaaccgatacaaagtcgcagtcgacgccgatgaaggtcgccggagaagagaggacaatatggtggagatccgcaagaacaagcgtgaagagagtttgctaaagaagcgacgcgaaggtctccaggcacaacagttccctcccgctattctctcttcttctaatgtggaaaagaagttagagaatttgccttcgatggtggctggtgtttggtctgaggatggcaatttgcagcttgaatcaactactcagtttcggaaactgctttcgattgagaggagtcctccgatagaggaagttatacaagctggggttgttcctcgatttgttgagtttcttgttagggaggatttccctcagcttcagtttgaggctgcttgggctctcacaaacattgcctctggaacttcagagaacactaaggtggtaattgatcatggtgcagttccaatatttgtcaagcttctcggttctcccagtgatgatgttagggagcaggctgtgtgggcattgggaaatgttgctggtgactcccctaagtgccgtgatcttgtgctcagccatggagccttgattccattgctggcacagttgaatgagcatgcaaagctttcaatgctgaggaatgctacgtggacactatcaaacttctgcaggggcaagccacagcctccgttcgagcaggtgaggccagcccttcctgcacttgaacgtcttgtacattcaactgatgaagaagtcctaactgattcttgctgggcactctcttatctttctgatggtacagatgataaaatccaagctgttattgaggcaggtgtctgtccacgacttgtggagctcctcctccatccttctccttcagtgcttgttcctgccctccgcacagttggaaatattgtgacaggggatgatatgcagacccagtgcataattaccactggtgcactcccatgccttctaagcctgctgactcataatcataaaaagagcatcaagaaagaagcttgctggactatctcaaacatcactgctggaaacaaggagcagatccaggctgttattgagaatggtttaattggcccgctcgttaatttacttcaaaatgcggagtttgatataaagaaagaagctgcttgggctgtgtctaatgctacttcgggtggcactcacgagcaaattaagtttttggtcagtcagggatgtattaaaccattgtgtgatcttcttgtatcccctgatccaaggattgtaactgtatctcttgaaggattagagaacattctgaaggttggggaagcggagaagaatttggggaatagtggagatgctaatttctatgcccagatgatagatgatgccgagggactagaaaagattgaaaatctacagagtcatgacaacaatgagatatatgagaaggcagtcaagattctcgagacttattggttggaagaagacgacgagactttgccttcaggtgatggtgcccagcaaggatttcagtttggtgggaacggtgttcaagttccatctggtggattcaacttttag

SEQ ID NO: 368 - protein, 529 aa, Populus trichocarpa
MSLRPSARTEVRRNRYKVAVDADEGRRRREDNMVEIRKNKREESLLKKRREGLQAQQFPPAILSSSNVEKKLENLPSMVAGVWSEDGNLQLESTTQFRKLLSIERSPPIEEVIQAGVVPRFVEFLVREDFPQLQFEAAWALTNIASGTSENTKVVIDHGAVPIFVKLLGSPSDDVREQAVWALGNVAGDSPKCRDLVLSHGALIPLLAQLNEHAKLSMLRNATWTLSNFCRGKPQPPFEQVRPALPALERLVHSTDEEVLTDSCWALSYLSDGTDDKIQAVIEAGVCPRLVELLLHPSPSVLVPALRTVGNIVTGDDMQTQCIITTGALPCLLSLLTHNHKKSIKKEACWTISNITAGNKEQIQAVIENGLIGPLVNLLQNAEFDIKKEAAWAVSNATSGGTHEQIKFLVSQGCIKPLCDLLVSPDPRIVTVSLEGLENILKVGEAEKNLGNSGDANFYAQMIDDAEGLEKIENLQSHDNNEIYEKAVKILETYWLEEDDETLPSGDGAQQGFQFGGNGVQVPSGGFNF

SEQ ID NO: 369 - DNA, 1590 bp, Solanum lycopersicum; identical to SEQ ID NO: 245

SEQ ID NO: 370 - protein, 529 aa, Solanum lycopersicum; identical to SEQ ID NO: 246

SEQ ID NO: 371 - DNA, 978 bp, Triticum aestivum
  misc_feature (885)..(885): n is a, c, g, or t
atgtcggtgcgtccgagcgagcgggccgacgcgcggcggaaccgctacaaggtgacggtggacgccgatgaggggcggcggcggcgcgaggacaacatggtggagatccgcaagaaccgccgcgaggagagcctcctcaagaagcgccgcgaggggctccaggcccaggctcctatccccgccgccggcgtcgagaagaagcttgaaagcttacctgctatggttggtggggtttattccgaggataacaacctgcagcttgaggcaacgacacaattccgcaagttgctttctatagaaaggagccccccaatcgaagaagttatccaatcaggcgttgttcctcgatttgtgcagtttcttactagagaggatttcccccaactccagtttgaagcagcgtgggcactcacaaacattgcgtctggcacatcagagaataccaaggttgtcattgatcatggggcagttccaatatttgtgaagcttcttgcatctggcagcgatgatgttcgtgagcaggctgtctgggcattgggcaatgttgctggtgactccccaaagtgccgcgaccttgtactcgcaaatggtgcattgatgcctctgctagcacagttgaatgagcatgctaaactctccatgttaaggaatgcgacctggactttatcaaatttctgcagaggaaagccacagccagcatttgatcagactaagcctgctctgccagcacttgcacgacttatccattccaatgatgaggaagttttaactgatgcatgctgggctctttcgtatctctctgatggcaccaatgacaagatccaatctgtgattgatgctggtgtctgtcctcggcttgtggagcttctcctccatcatcacctnaagggcttatactggcctagaactggtggaatatggtccagggagatactccaaaaccaggggttattgatcatcagctctggggtgtcctaa

SEQ ID NO: 372 - protein, 325 aa, Triticum aestivum
MSVRPSERADARRNRYKVTVDADEGRRRREDNMVEIRKNRREESLLKKRREGLQAQAPIPAAGVEKKLESLPAMVGGVYSEDNNLQLEATTQFRKLLSIERSPPIEEVIQSGVVPRFVQFLTREDFPQLQFEAAWALTNIASGTSENTKVVIDHGAVPIFVKLLASGSDDVREQAVWALGNVAGDSPKCRDLVLANGALMPLLAQLNEHAKLSMLRNATWTLSNFCRGKPQPAFDQTKPALPALARLIHSNDEEVLTDACWALSYLSDGTNDKIQSVIDAGVCPRLVELLLHHHLKGLYWPRTGGIWSREILQNQGLLIISSGVS

SEQ ID NO: 373 - DNA, 1470 bp, Zea mays
atgtcgctccggccgagcgagcgggagcagatgcggaagggcaactacaagcagacggtggacgccgaggagagccgccgccgccgcgagggccagatggtcgacatccgcaaggccaagcgagaggaaagcctccagaagaagcgccgcgatgggttccccgccgccggcgccgtgccgccgatgggccactccaccgcactccagcagaagctcgatggcttgccggcgatggtacaggccgttcactccaacgaccccactgtgcagcttgaggccaccacgcagttcaggaagctgctctccatagagcgtagtcccccaattgaagaggtgatcagcacaggagtcgtgccccgattcattgagttccttacacgtgaggaccatccacaactccagtttgaggctgcatgggcgctcaccaacattgcatcaggcacatcagagaacactaaggtggtggttgagagtggtgctgtgcccatctttgttaagctcctcaactccaatagcgaggatgttcgtgaacaggctgtatgggctttaggtaatgttgctggtgactccccaaagtgccgtgatctggtgctaggccatggtgggctattccccttgctgcaacagcttaatgagcatgctaagctctcgatgctgaggaatgccacatggacactatcaaacttctgccgtgggaagccacaaccgaactttgatcaggtcaaaccagcattgccagcacttcagcaacttatccactctcaggatgaggaggtcctaactgatgcctgttgggctctatcatacctatctgatgggactaatgacaaaatccaagctgttattgaatctggcgtgttccctcgccttgtggaacttctgatgcatccttcagcctctgtactgattccagctctgcgcacggtgggtaacatcgtaactggggacgacatgcagactcagtgtgtcattgacaatcaagcacttccatgccttttgaacctactgaccaccaaccacaagaaaagcatcaagaaagaagcatgctggacaatctcaaacatcacagctggtaacagggaacagattcaggccgtgattaatgcaaacataattgcacctctggtgcaacttctgcaaactgctgaatttgacatcaagaaagaagcagcctgggcaatttcaaatgccacttctggtggcacacatgatcagatcaagtaccttgttgcccagggttgcattaagccactctgtgatctgcttgtttgcccggatcccagaatcgtaacagtttgcttggagggtctcgagaacatcctgaaagttggcgaggcagagaaaaaccttggtgcaggcgatgtcaatgtctacgcacagatgattgatgatgctgagggcctggacaagattgagaactgcagagccatgacaacaccgagatatatgagaaggctgtcaagatgctga

SEQ ID NO: 374 - protein, 489 aa, Zea mays
MSLRPSEREQMRKGNYKQTVDAEESRRRREGQMVDIRKAKREESLQKKRRDGFPAAGAVPPMGHSTALQQKLDGLPAMVQAVHSNDPTVQLEATTQFRKLLSIERSPPIEEVISTGVVPRFIEFLTREDHPQLQFEAAWALTNIASGTSENTKVVVESGAVPIFVKLLNSNSEDVREQAVWALGNVAGDSPKCRDLVLGHGGLFPLLQQLNEHAKLSMLRNATWTLSNFCRGKPQPNFDQVKPALPALQQLIHSQDEEVLTDACWALSYLSDGTNDKIQAVIESGVFPRLVELLMHPSASVLIPALRTVGNIVTGDDMQTQCVIDNQALPCLLNLLTTNHKKSIKKEACWTISNITAGNREQIQAVINANIIAPLVQLLQTAEFDIKKEAAWAISNATSGGTHDQIKYLVAQGCIKPLCDLLVCPDPRIVTVCLEGLENILKVGEAEKNLGAGDVNVYAQMIDDAEGLDKIENCRAMTTPRYMRRLSRC

SEQ ID NO: 375 - DNA, 1113 bp, Brassica napus
atggcgacgcattccatctctcgctccattctctgccgtccggcgaaatctctctcccttctcttcacccgatccttcgcctcatctgctcctctcgccaaagctccggcgacttcgctttacacgtcgtctctgctcacccgatcccgtcccttagtcgccgccttgtcatccgctttccgcggtggacttgtgtctgtcaaaggtctttcttcgcaggctacatcgtcttctctgaacgatccgagtcccaactggtccaacaggcctccaaaggagacgattttgctcgatggatgcgatttcgagcattggcttgtggttgtggatccgcctgagggagatcccactagagatgagatcatcgacagctatatcaaaaccctagctcagatcgttggcagtgaagaagaagcgaggatgaagatctactctgtttcgactcgatgttactttgcttttggagctcttgtgtctgaagatctctctcacaagctgaaagagttgccaaaggtgcgctgggtccttcctgattcgtacctggatgtgaggaacaaagactacggaggggaacctttcattgatgggaaagctgttccttatgaccccaagtaccacgaggaatggataaggaacaatgctagagccaatgaaagaaacaggcgcaatgaccgtcctaaaaactttgatagaagcagaaactttgagaggagaagagagaacatggcaggaggccctcctccccaacgtcctcccatgggtggccctcctccacctcacatgggtggctctgcaccccctccacctcccatggggcagaattatggacaaaggcctccaccaaactacggaggaccaccaccaccaaattacggaggaacgccaccacaaaacaacatgggaggagcaccaccaccaaactacggaggagcgcctccaccgaactatggaggagcaccaccaccgcagaacaacatgggaggaggaggtccaccaaatgcaggatggtcaggtaacaaccactaccagcagcagcagggtggtggaatgcagcagccacagtaccagaacaactatccacctaaccgggatggcagcgggaacccgtactag

SEQ ID NO: 376 - protein, 370 aa, Brassica napus
MATHSISRSILCRPAKSLSLLFTRSFASSAPLAKAPATSLYTSSLLTRSRPLVAALSSAFRGGLVSVKGLSSQATSSSLNDPSPNWSNRPPKETILLDGCDFEHWLVVVDPPEGDPTRDEIIDSYIKTLAQIVGSEEEARMKIYSVSTRCYFAFGALVSEDLSHKLKELPKVRWVLPDSYLDVRNKDYGGEPFIDGKAVPYDPKYHEEWIRNNARANERNRRNDRPKNFDRSRNFERRRENMAGGPPPQRPPMGGPPPPHMGGSAPPPPPMGQNYGQRPPPNYGGPPPPNYGGTPPQNNMGGAPPPNYGGAPPPNYGGAPPPQNNMGGGGPPNAGWSGNNHYQQQQGGGMQQPQYQNNYPPNRDGSGNPY

SEQ ID NO: 377 - DNA, 1260 bp, Gossypium hirsutum
atggcgacccaatccctctctcgctatctcctctccaaaccaaaatccctaacctccttcctcttcccttcatgcccccctttctcttccttttcccccgccgccgccgcttcccccgtgaaaaccctaataacctcatcgccatccccttccctctttttcctccgtcgtctccgtgccccactttgctactcgctcctccttcgcgactcacttttccccactgtcaaatcgttctccactcgagcagccaggtcctctctcaatgacccgagtcctaattactcgaatcgtcccccgaaggagacaatattgctcgacggctgtgattttgagcattggctcgttgtggtggagccccctaaagaggatgctactagggatgaaattattgatagttatatcaaaaccctagctcaagtagtgggcagtgaagacgaagctagaatgaaaatttattcagtttctactcggcattattatgcctttggagcccttgtttctgaagagctctcgtacaagatcaaggaacttcctggagttcgttgggttcttccagattcttacttggacgtgaagaataaagattatggaggtgaacctttcattaatgggcaagctgtgccttatgatcccaagtaccatgaggaatgggtgaggaacaatgcacgtgcaaatgaaagaaatagacgtaatgacaggcctcgtaattatgacagatcaagaaactatgagagaagaagggaaaacatgcagcctcctcctaaccagggtatgcagaatgcttctcctaatacagctagaagtccacctcctaacaacatgggaggaatgccttacaacaataggggaagtatgcatgccaacaacatggggggaggaatgcctcctcctaacaatatgggaggaatgccgcctcctaacaatatgggaggaatgccgcctcctaacagtatgggaggaatgccgcctcctaacagtatgggaggaatgccaccgcggaacaacatgggaggaggaatgccgcctcctaacaatatgggaggaatgccgcctcctgacaacatgggaggaggaatgccgccgccgaacaacatgggtgggatgccaccgggaccaccgaatcaaggatggtctggtaacatgggtggaaatgctcagaatttccaaaatccttaccaaggtaatacacagaatgtgcaatatccgaataaccatccgccaaatatgggcgggcctggtgggaattaccagtcttag

SEQ ID NO: 378 - protein, 419 aa, Gossypium hirsutum
MATQSLSRYLLSKPKSLTSFLFPSCPPFSSFSPAAAASPVKTLITSSPSPSLFFLRRLRAPLCYSLLLRDSLFPTVKSFSTRAARSSLNDPSPNYSNRPPKETILLDGCDFEHWLVVVEPPKEDATRDEIIDSYIKTLAQVVGSEDEARMKIYSVSTRHYYAFGALVSEELSYKIKELPGVRWVLPDSYLDVKNKDYGGEPFINGQAVPYDPKYHEEWVRNNARANERNRRNDRPRNYDRSRNYERRRENMQPPPNQGMQNASPNTARSPPPNNMGGMPYNNRGSMHANNMGGGMPPPNNMGGMPPPNNMGGMPPPNSMGGMPPPNSMGGMPPRNNMGGGMPPPNNMGGMPPPDNMGGGMPPPNNMGGMPPGPPNQGWSGNMGGNAQNFQNPYQGNTQNVQYPNNHPPNMGGPGGNYQS

SEQ ID NO: 379 - DNA, 1206 bp, Glycine max
atggcgactcagatcctctctcgcatcttccccaaaaccctagcccccttcctctcccgttctctctccaccgccccctctcctccctccctctccgcgctctccttcctccgccgcatctccgttgccgccaacccctccctccaccgcgccctcctccccaactctccctccctccgcgccctctccacacgcgccactacctcctccctcaacgaccccaaccctaactggtccaaccgtcccccgaaagaaaccatcttgctcgacggctgcgatttcgaacactggctcgtcgtcatggagaagcccgagggagaccccacacgcgatgacatcatcgatagctacatcaaaacattggccaaggtcatcggaagtgaagaggaggcgagaatgaagatatattcggtctcgactaggcactactttgcgtttggggctcttgtgtctgaagagctttcttacaagattaaagaattgcctggagttcggtgggtgcttcctgattcttacttgaatgttaaggaaaaggattatggaggtgagccctttattaacgggcaagctgctccctatgatcccaagtatcacgaagagtgggttagaaacaatgctcgtgccaatgagagaaacaggcgcaatgacaggcctcgtaatgctgacaggtcaagaaactttgagaggaggagggaaaatgtggtaaacagagacatgcagggcaggcctccttcgccaaatcctggccctaatgtgggcggtcctcctccaagcaatgcagctgggtaccctccaagcaatgcagctgggtaccctcctagcaatgcaggatatgcccctccaagcaatacaggcgggtaccctcctagcaatgcaggatatgcccctccaagcaatgcaggcgggtaccctccgagcaatgcaggctatgcccctccgagcaatgcaggctatgcccctccaaatacagctggatattcttctccgaacgccgcaggaggttaccctcctaatgcaggtggtggctatggtcctggtggtggtgtgcctcagaataactacgcagggaacatgggagggccaccatcaaaccagaacatgggagggtttcaacaaaattcaggatggtcgaacaatgctcccagtagagatgtgccaagcagggatatgggaggaccacctggtgggaacccatattctgggtga

SEQ ID NO: 380 - protein, 401 aa, Glycine max
MATQILSRIFPKTLAPFLSRSLSTAPSPPSLSALSFLRRISVAANPSLHRALLPNSPSLRALSTRATTSSLNDPNPNWSNRPPKETILLDGCDFEHWLVVMEKPEGDPTRDDIIDSYIKTLAKVIGSEEEARMKIYSVSTRHYFAFGALVSEELSYKIKELPGVRWVLPDSYLNVKEKDYGGEPFINGQAAPYDPKYHEEWVRNNARANERNRRNDRPRNADRSRNFERRRENVVNRDMQGRPPSPNPGPNVGGPPPSNAAGYPPSNAAGYPPSNAGYAPPSNTGGYPPSNAGYAPPSNAGGYPPSNAGYAPPSNAGYAPPNTAGYSSPNAAGGYPPNAGGGYGPGGGVPQNNYAGNMGGPPSNQNMGGFQQNSGWSNNAPSRDVPSRDMGGPPGGNPYSG

SEQ ID NO: 381 - DNA, 1248 bp, Hordeum vulgare
atggcgtcggcgtcgcgcgcgctcctcctctccagggcctcgcccctccacgccgccgcctcccgcttcctccgcccgctcgccgccgcggggagcctcctcccggcggcgctggtcccgtcccccgccgcggcgccctgggcggcggcgaggcgattcgcgacgcagcccgccaactcgtcgctgcgggactcgtccccgaactggagcaaccgcccgcccaaggagacgatcctcctcgacggctgcgacttcgagcactggctcgtcgtcatggagccgcccccaggcgacggcgccaaccccgacgtcacccgcgacgagatcatcgacgggtacatcaagaccctcgcacaggtcgtcggaagtgaagatgaagccaggatgaagatctactctgtgtcaactaggcattattttgcttttggtgccctagtatctgaggaactctcctacaaactcaaagagttgcctaaggtccgttgggttcttcctgattcatacctcgatgtcagaaataaggactatggaggagaaccatttatagatggacaagctgttccttacgaccccaaataccatgaggagtgggtgagaaacaatgcccgtgccaatgagagatcccggcgcaacgacaggcctcgcaactttgacaggtcgaggaactttgaaaggagaagggagaacacacaggcctaccagagcgggcctgctccaccagggcagagccaaatgccaccccatgatgctgctcctccaaggcgtcctccacagggcccgccaccgccttcgggtgccccaccaaattaccagtcccatgccccaaacccacaggcgggctatgttccaggaggtggaccaaactatcagaatgcaccgccgccccctggataccaaggtgccccaacccctggataccaaggtgccccaacccctgggtaccaagctggtaaccaaggctaccaaggtaatcctggtggtaacatgcagaatggaccaggcccagcccatcatagcaacaaccctggataccaccagggtggagggccaggtgtcaacccgtcgcccccttttgcaggtggcaaccagcctcctccctaccaaggcagtggccctagctatggtggtggtgcaccaggctaccagggccagccaggtaacccaggctacgaaggtggcggtaactacaacaacgccgcccctcctccctatgagggcagggacgggccagggaggaactaccagtag

SEQ ID NO: 382 - protein, 415 aa, Hordeum vulgare
MASASRALLLSRASPLHAAASRFLRPLAAAGSLLPAALVPSPAAAPWAAARRFATQPANSSLRDSSPNWSNRPPKETILLDGCDFEHWLVVMEPPPGDGANPDVTRDEIIDGYIKTLAQVVGSEDEARMKIYSVSTRHYFAFGALVSEELSYKLKELPKVRWVLPDSYLDVRNKDYGGEPFIDGQAVPYDPKYHEEWVRNNARANERSRRNDRPRNFDRSRNFERRRENTQAYQSGPAPPGQSQMPPHDAAPPRRPPQGPPPPSGAPPNYQSHAPNPQAGYVPGGGPNYQNAPPPPGYQGAPTPGYQGAPTPGYQAGNQGYQGNPGGNMQNGPGPAHHSNNPGYHQGGGPGVNPSPPFAGGNQPPPYQGSGPSYGGGAPGYQGQPGNPGYEGGGNYNNAAPPPYEGRDGPGRNYQ

SEQ ID NO: 383 - DNA, 1128 bp, Medicago truncatula
atggcgaaccagatcttctctcgcgtcatccccaaaaccctaaccctaaccaccttcctctctcgctccttctccaccacaaccaccaatccctcttcctccgctctctcctttctccgccgtctccgccctctctccgccaccgccatcacctcccgtcacatcctcctcccttccttccgcgctttctccacacgccctaccacctcttccctcaacgatcctaaccctaattggtctaatcgtccaccaaaggaaacgattttgctcgatggatgcgattttgaacactggcttgttgtgatggagaagcctgaaggtgatcctaccagagatgagattattgatagttacatcaaaaccttagctgaggttatcggaagtgaagaagaggctaggaagagcatatattctgtttcaactagacactactttgcttttggagctctttgttctgaagagctttcctacaaactgaaagaactgcccaaggttcgatgggttcttcctgattcttatttgaatgtgagggagaaagattatggaggtgagcccttcattaatgggcaagcagttccatatgatcccaagtatcatgaggagtgggttaggaacaatgctcgtgctaatgaaaggaacaggcgcaatgataggcctcgtaataacgacaggtcaagaaattttgaaaggagaagggaaaatgtggtgaacagagacatgcagagtaggcctccagtgcagaattctggtccacctcccaacaattcttctggataccctcccaacaattcttctggataccctcccaacaatgctggcggataccctcctaacaatcaagctggatactcccctccaaatcaatctggatactcccctccaaatcaagctggatacgcccctccaaatcaaggcggatacgcccctccaaatcaaggtggatatgctcctccaaatgcaggtggtggataccctccccccaacatgagcggaccccctcctcctaacatgagcagacctcctcctcccaacagtggatacggtgctcctcaaaataactacctggggcaacaaaaccagaacattgcagggatgcctccaaatgctggatggtcaaataatcagtag

SEQ ID NO: 384 - protein, 375 aa, Medicago truncatula
MANQIFSRVIPKTLTLTTFLSRSFSTTTTNPSSSALSFLRRLRPLSATAITSRHILLPSFRAFSTRPTTSSLNDPNPNWSNRPPKETILLDGCDFEHWLVVMEKPEGDPTRDEIIDSYIKTLAEVIGSEEEARKSIYSVSTRHYFAFGALCSEELSYKLKELPKVRWVLPDSYLNVREKDYGGEPFINGQAVPYDPKYHEEWVRNNARANERNRRNDRPRNNDRSRNFERRRENVVNRDMQSRPPVQNSGPPPNNSSGYPPNNSSGYPPNNAGGYPPNNQAGYSPPNQSGYSPPNQAGYAPPNQGGYAPPNQGGYAPPNAGGGYPPPNMSGPPPPNMSRPPPPNSGYGAPQNNYLGQQNQNIAGMPPNAGWSNNQ

SEQ ID NO: 385 - DNA, 1191 bp, Oryza sativa
atggcgtcggcgtcgcgcttcctcctcctctccaggctccccgccgccgccgcctcctccacctcccgcctcctccgcccgctctccgccgcggggagcctcctcccggcggcgctcgccccctccgccccgcgcgcggcggcggcggcggcgaggtgcttcgccacgcagcccgcgacctcctcgctgcgggactcgtcgccgaactggagcaaccggccccccaaggagacgatcctcctcgacgggtgcgacttcgagcactggctggtcgtcgtggagccgccccccggcgatccctccaacccggagcccacccgcgacgagattatcgacggctacatcaaaaccctcgcacaggtggttgggagtgaggaagaagcaaggcataagatctactcagtgtcaactcggcattactttgcttttggagctcttgtatctgaggaactctcctacaaactcaaagagttgcccaaggtccgctgggttcttccagactcatacctggatgtcagaaataaggactacggaggagaaccttttataaatggggaagccgttccttatgaccctaagtaccacgaggagtgggtgagaaacaatgcgcgtgccaatgaaagaagccggcgcaatgataggcctagaaactttgacaggtcaaggaattttgagaggagaagggagaacatgcagaacttccagaacagagatgtgcctcctggccagggattcaacagccctcccccaccaggtcagggcccagtcccgcctcgtgatgctcctccgatgcaccatgctcagggtaatgttcctccacctccaccaccaaatgcaggtcctccaaactaccagccccatgcaccaaatccgcaaggctatacaaactatcagcagggcggtgcgcctggctaccaaggtggaccccctggctatcaaggtagcaaccagggctaccaaggtccacccccacccccaccatctgcttaccaaggcaacaaccctggataccagggaggagggccaggttaccagggcggcaacccgcctccttaccaaggtggcaaccctggctatgcaccaggctaccatggccaaggaggcaaccctagctaccagcaaggcggcgataactacaatgccggtgtgccggcttatgagagggacggacaagggaggaattaccagtag

SEQ ID NO: 386 - protein, 396 aa, Oryza sativa
MASASRFLLLSRLPAAAASSTSRLLRPLSAAGSLLPAALAPSAPRAAAAAARCFATQPATSSLRDSSPNWSNRPPKETILLDGCDFEHWLVVVEPPPGDPSNPEPTRDEIIDGYIKTLAQVVGSEEEARHKIYSVSTRHYFAFGALVSEELSYKLKELPKVRWVLPDSYLDVRNKDYGGEPFINGEAVPYDPKYHEEWVRNNARANERSRRNDRPRNFDRSRNFERRRENMQNFQNRDVPPGQGFNSPPPPGQGPVPPRDAPPMHHAQGNVPPPPPPNAGPPNYQPHAPNPQGYTNYQQGGAPGYQGGPPGYQGSNQGYQGPPPPPPSAYQGNNPGYQGGGPGYQGGNPPPYQGGNPGYAPGYHGQGGNPSYQQGGDNYNAGVPAYERDGQGRNYQ

SEQ ID NO: 387 - DNA, 1227 bp, Populus trichocarpa
atggcgacttcactcttcactcgctctctcttcctccaaaaacccacctcacaaaccctaatttcctccctcctctctcgcgccttcacttcccactcctccacctccaccgcctgttcctcctctctcctccgccgattcctccgtcctctctcctctgcaaccaccatcaatcgctccgtctctcggatttcaatcaggtcgttttcttccagtcagaaatcgtcttccctcaacgacccaagccctaactggtctaatagacctccaaaagagactattttgcttgatggctgtgatttcgagcattggctcgtcgttatggaaaagcctgagggagaccccactcgtgacgagatcatcgattcttatattaaaactcttgctcaagttgttggcagtgaggaagaagcaaggaggaagatctattcagtttctactcgatgctattatgcctttggagctctggtgcctgaagaggtttcttacaagattaaagaattgaaaaatgtccgctgggttcttcctgattcatacctggatgtgaagaacaaagattatggaggcgagccatttattgatgggaaagctgtgccctatgacccaaaataccatgaggaatggattaggaacaatgcgagggcaaatgaaagaaataggcgcaatgatcgacctcgtaacgtcgacagatcaaggaactttgacagaagaatggaaaacatgcagccgcgaggtggagctccacctcctcctatggctaatcaggctatgcgaaaccctgctcccaacatggctggacaaccacaaaacatgggcagacaaggtgcaccaccgcagccacaaaacaactacaggggaccaggtggaccgccacctaacaactataatatgggtggaccaggtggaccgccacctaacaactatatgggtgggcagcagaacaatatgagtagggtgccacataacatgcccatgcaaaactacattcctccacagaacaacatgcccccgcagaacaatatgccccctcaaaactacaccccccaacaacacaactacattcctccgcagaacaacatgcctccacataacaacacaggaggatggtccaatgacatgcctggaaacatgcaacacaacatccagaatgagcctgccaatggaggctaccaaggtggaccatcaaactaccataacaaataccctccaagccaggatgctgtgtag

SEQ ID NO: 388 - protein, 408 aa, Populus trichocarpa
MATSLFTRSLFLQKPTSQTLISSLLSRAFTSHSSTSTACSSSLLRRFLRPLSSATTINRSVSRISIRSFSSSQKSSSLNDPSPNWSNRPPKETILLDGCDFEHWLVVMEKPEGDPTRDEIIDSYIKTLAQVVGSEEEARRKIYSVSTRCYYAFGALVPEEVSYKIKELKNVRWVLPDSYLDVKNKDYGGEPFIDGKAVPYDPKYHEEWIRNNARANERNRRNDRPRNVDRSRNFDRRMENMQPRGGAPPPPMANQAMRNPAPNMAGQPQNMGRQGAPPQPQNNYRGPGGPPPNNYNMGGPGGPPPNNYMGGQQNNMSRVPHNMPMQNYIPPQNNMPPQNNMPPQNYTPQQHNYIPPQNNMPPHNNTGGWSNDMPGNMQHNIQNEPANGGYQGGPSNYHNKYPPSQDAV

SEQ ID NO: 389 - DNA, 1176 bp, Solanum lycopersicum
atggcgactcgttatcttactcgttctctactcactactctctctcgctcatacactactctttctctctctacacctcttccatcttctttctctctcctccgttttcgtcctctcatcgccgtcgcagcgaatcttcgaacatttactccggcgacgttaacggcggcgacgtcgtttagaggtttcgcgactcgtcaaacgtcgtcgtcgttgaatgacccgaacccgaactggtctaatcgtccaccgaaggagacgattttgcttgatggatgtgattttgagcactggcttgttgtgatggagaagcctgaaggtgatcctacaagagatgagattattgatagttacatcaaaactcttgctacgattgtcggaagtgaggaggaagcaagaatgaagatctactctgtctcgacaagacattactttgcatttggagctcttgtatccgaagaactttcttacaagctcaaagaattgccgaaggttagatgggtgcttcctgattcctacctggatgttaaaaataaagattatggaggagaaccttttattaatgggcaggctgtaccctatgacccgaaataccacgaggagtgggtgaggaacaatgcccgagctaatgagagaaacagacgtaatgaccgacctcgtaactttgatagatccagaaattttgagagaagaagagagatgcagaaccctggatccagtatgggtggtggacctcccaatatgagaaatgctccaccccctaacatgggtgaaatgcagcagcagcagcaacctaacatgggcggaatgcagcagcagcaacctaacatgggaggtatgcaccagcaacagcagcccaacatgggcgggatgcaccagcctggcatgggagggccaccgcctaactatggtggagggcctcccagaaactatggtggagcacctcccaataactatggtggagcaccaaacaatcaatataatggtggaccaaacaatgggggcggcatgccttaccaaacaggtccaggaccaaaccagaactatgcatctggtggaaaccattatcagaacccaaatatgccccctccaagtcagaactatgctccgaatacgcctggtggaaaccttcatcagaatcaaaacatgcctggaagagatccaaattatcaatag

SEQ ID NO: 390 - protein, 391 aa, Solanum lycopersicum
MATRYLTRSLLTTLSRSYTTLSLSTPLPSSFSLLRFRPLIAVAANLRTFTPATLTAATSFRGFATRQTSSSLNDPNPNWSNRPPKETILLDGCDFEHWLVVMEKPEGDPTRDEIIDSYIKTLATIVGSEEEARMKIYSVSTRHYFAFGALVSEELSYKLKELPKVRWVLPDSYLDVKNKDYGGEPFINGQAVPYDPKYHEEWVRNNARANERNRRNDRPRNFDRSRNFERRREMQNPGSSMGGGPPNMRNAPPPNMGEMQQQQQPNMGGMQQQQPNMGGMHQQQQPNMGGMHQPGMGGPPPNYGGGPPRNYGGAPPNNYGGAPNNQYNGGPNNGGGMPYQTGPGPNQNYASGGNHYQNPNMPPPSQNYAPNTPGGNLHQNQNMPGRDPNYQ

SEQ ID NO: 391 - DNA, 759 bp, Triticum aestivum
atggcggctgtaggcgtcacacggcggaggctctcggcgctcctcctctcctcccgtgcgattccccgtcgcctcctcctcctcaccggcgccgccgcctctgcgccctcagcccacccctctccgtgggcgccgccgtcgcgaggggcaaagacggcgctgccgggaaggcccgggtactctccgctcaacgacccgtccccgaactggagcaaccggccacccaaggagaccatcctgctggatggctgcgactacgagcactggctcattgtcatggagttccccgccgaccccaagccctccgaggaagatatggtggccgcctacgtcaagaccctcaccgctgtgctcggaagtgaggaggaggcaaagaagaagatctactcagtatgcactacaacttacacagggtttggtgcgttgatttcggaggagttatcatacaaagttaaaggattgccgggagttctttgggtattacctgattcatatttggatgtgcctaacaaggattatggaggtgatctctttgtagatggcaaagtcattcataggccacaatttcagttcactgagaggcagcaggtaaggagcagacctcgtccccgctatgacaggcgacgagagactatgcaggttgagcgaagagaaactatgcagagaggtccttcagtacaagagcacagacctccgttttctaagcaggttgctcaaaataatgggcagcatgaaatcgtaccgccaggaaggaactaa

SEQ ID NO: 392 - protein, 252 aa, Triticum aestivum
MAAVGVTRRRLSALLLSSRAIPRRLLLLTGAAASAPSAHPSPWAPPSRGAKTALPGRPGYSPLNDPSPNWSNRPPKETILLDGCDYEHWLIVMEFPADPKPSEEDMVAAYVKTLTAVLGSEEEAKKKIYSVCTTTYTGFGALISEELSYKVKGLPGVLWVLPDSYLDVPNKDYGGDLFVDGKVIHRPQFQFTERQQVRSRPRPRYDRRRETMQVERRETMQRGPSVQEHRPPFSKQVAQNNGQHEIVPPGRN

SEQ ID NO: 393 - DNA, 1236 bp, Zea mays
atggcgtcggcgtcgcgtgcgctcctcatctctcgtgcgctccaggccggcgccgtgtctcgccgcgtccccgccctcctgcgccctgtcgctgctgccgcgagcctcctcccagcggtggcggggccggcaggggccgccctcggcgctagggtgcggtgcttcgcgacccagccggcgacgtcctcgctgcgggactcgtccccgaactggagcaatcgcccgcccaaggagacgatcctcctcgacggctgcgacttcgagcactggctcgtcatcatggagccgccgcctggtgacgcctccaaccccgacatcacacgcgacgagatcatcgatagctatatcaagactctcgcccaagtcgtcgggagtgaggaagaagctaggcaaaagatatactctgtatcgactcgtcattactttggctttggtgctcttgtatctgaggaactttcttacaaactgaaagaaattcccaaggtccgctgggttcttcctgattcatacttggatgtcaaaaacaaggactatggaggcgaacccttcataaatgggcaagctgttccttatgatcctaaatatcatgaagagtgggtgagaaacaatgcccgtgccaatgacagaaaccggcgcaatgataggcctcgcaactttgacaggtcaaggaactttgacaggagaagggagaacatgcaaaactaccagaacagagatgggcctcctgcccaaggtttcaatggccccccacctccacctggccagaaccagatgccatcccaccatagtcagggcaacatgtctccgcaaccaccacatgctggtggtggccaaccaaactatcagccccaaatgcaaaacccacagacgggctacaaccctggcggtgctcctcactaccagcaaggtgctgctcctggctaccaaggtggacctccggggtatcaaggtggttaccaagggaacccaggccctgcctaccaaggtggtaacactggttatcaaggtggcaacccaccacctccctaccaaggaagcaacccaccacctccttaccagggaggcagcccaccagggccaccacctccctaccgaggaggcagcccaccagggccaccacctccctaccgaggaggcaaccccaacgtaccgccatattcgggtggtggcaatcctggctaccctggtggcagccctggctaccagggtcaaggaggcaactccaacttccagtga

SEQ ID NO: 394 - protein, 411 aa, Zea mays
MASASRALLISRALQAGAVSRRVPALLRPVAAAASLLPAVAGPAGAALGARVRCFATQPATSSLRDSSPNWSNRPPKETILLDGCDFEHWLVIMEPPPGDASNPDITRDEIIDSYIKTLAQVVGSEEEARQKIYSVSTRHYFGFGALVSEELSYKLKEIPKVRWVLPDSYLDVKNKDYGGEPFINGQAVPYDPKYHEEWVRNNARANDRNRRNDRPRNFDRSRNFDRRRENMQNYQNRDGPPAQGFNGPPPPPGQNQMPSHHSQGNMSPQPPHAGGGQPNYQPQMQNPQTGYNPGGAPHYQQGAAPGYQGGPPGYQGGYQGNPGPAYQGGNTGYQGGNPPPPYQGSNPPPPYQGGSPPGPPPPYRGGSPPGPPPPYRGGNPNVPPYSGGGNPGYPGGSPGYQGQGGNSNFQ

SEQ ID NO: 395 - DNA, 1083 bp, Brassica napus
atggaagcccttgttgttgatgctggttcgaagctcctgaaagcaggagcagcgattcctgaccagtctcctgcaatgataatcccatctcagatgaaacgaatggttgatgatgcgtctgataaccccaccactgtttttgaagacgtcactcttgatcctatcgaaagagggttcattagagactgggacgctatggaggatctgttgcgttacgttgtgtacactgggcttggatgggaagagggaaacgaaggcaacatactcttcacagatccactctgcactcctaaggctattagggagcagttagtgcagttgatgtttgaaacgttcaacgtgtctggattctatgcgtcagagcaagcagtgttgtctctttatgctgttggaagaatctccggttgcactgttgatattggtcatgggaagatagatattgccccagttcttgaaggtgctgtgcagcacattgcctcaaaacggtttgagctcggtggaacggatcttacaaaactattcgcccaagagcttggaaaatccaacccttctgtgaatctcagcatgtctgatgttgaaacattgaaggaacagtatgcaaactgtgctgaggacgaggttgcgtacgagaaaacccaaaactgtgaaatcgagcagcatacacttcctgatggacaggtgataaacattgggagagagagatactctgttggtgaagctttgtttcagccatcaatacttggactggaggagcacggaatagttgaacagcttgtccggattatctcaacagtatcatctgagaaccataggcaactcttggagaacactgtactttgtggtggtacaacctccatgacaggattcgaaggaaggtttcagaaagaagcaagcttgtgctcatctgccattaggccaacgctggtgaaacctcctgaatatatgagtgagaatttgggattgtactcggcttggataggaggagcaatactagccaaggtggtgtttccgcagaatcagcatgttactaaagctgactacgacgagactggaccatctgtggttcacaggaaatgtttctga

SEQ ID NO: 396 - protein, 360 aa, Brassica napus
MEALVVDAGSKLLKAGAAIPDQSPAMIIPSQMKRMVDDASDNPTTVFEDVTLDPIERGFIRDWDAMEDLLRYVVYTGLGWEEGNEGNILFTDPLCTPKAIREQLVQLMFETFNVSGFYASEQAVLSLYAVGRISGCTVDIGHGKIDIAPVLEGAVQHIASKRFELGGTDLTKLFAQELGKSNPSVNLSMSDVETLKEQYANCAEDEVAYEKTQNCEIEQHTLPDGQVINIGRERYSVGEALFQPSILGLEEHGIVEQLVRIISTVSSENHRQLLENTVLCGGTTSMTGFEGRFQKEASLCSSAIRPTLVKPPEYMSENLGLYSAWIGGAILAKVVFPQNQHVTKADYDETGPSVVHRKCF

SEQ ID NO: 397 - DNA, 858 bp, Gossypium hirsutum
atggaggcggcagtggtcgatgctggctccaagctcctcaaggcgggacttgctgtcccagatcaggctccatccttgataatacctactcaaatgaaacgtatgctggaagatggatcatctgttgataattcattgttagaagatgttaccattgatcctgttgtgcgaggatgcgttaaagactgggatgccatggaagatttgttgcaccatgttctatacacgggccttgaatgggaagttggaaatgaaggacaaattttgtttactgaaccgctttgtactcccaaggctgttagagaacgactggtgcaattgctatttgaaacttttaatgtatcgggattttatgcgtcggaacaagcagtattatctctgtatgctgtcgggcgtatctcaggttgtactgttgatattggtcatgggaagatagacatagctgcagtacttgaaggtgctgtccaacacattgcctcaagaagatttgaagttggaggtattgatttgacaaagctacttgctcaagagctgggtaaatcaaatcctatggtgaacctcagcttatctgatgttgagaaactaaaagagcaattctcgtgttgtgctgaagatgaagttgcttatgacagaatgctcagatcatgtgaaacagaggaacatactcttcctgatggacaggtgataagaattggaagggaaagatttactgttggtgaggcattgttccaccatctatattgggctagaagctcatggaattgtgagcagcttgttcgtaatattgcaacggtttcttctgagaaccaaaagcaacggttaaaaataccgttctttggggtgggactacctctatga

SEQ ID NO: 398 - protein, 285 aa, Gossypium hirsutum
MEAAVVDAGSKLLKAGLAVPDQAPSLIIPTQMKRMLEDGSSVDNSLLEDVTIDPVVRGCVKDWDAMEDLLHHVLYTGLEWEVGNEGQILFTEPLCTPKAVRERLVQLLFETFNVSGFYASEQAVLSLYAVGRISGCTVDIGHGKIDIAAVLEGAVQHIASRRFEVGGIDLTKLLAQELGKSNPMVNLSLSDVEKLKEQFSCCAEDEVAYDRMLRSCETEEHTLPDGQVIRIGRERFTVGEALFHHLYWARSSWNCEQLVRNIATVSSENQKQRLKIPFFGVGLPL

SEQ ID NO: 399 - DNA, 1086 bp, Glycine max
atggaagcggcagtggtggacgtcggctctaagctcctcaaagcgggctttgcaattcctgaccagactcctgccatgataattcccactcagatgaagcaattactcgatgatggatccgtcgcagataattcactggctgacaatgtcaccgttgatcccgttgtgcgaggatttattagagattgggatgcaattgaggatttgttgcaccatgttttgtataccggcctcggatgggaaattggcaatgaaggacaaatactatttacagatccactttgtaccccaaaggcgaacaaagaacagttggtgcaactaatgtttgaaacattcaatatatcaggattttatgcctcagaacaagcagtgttatcactctatgctgtgggacgtatctcaggctgcactgttgatattggacatggaaaaatagatattgcaccggtaattgagggtgctgttcaccacatcgcctcgagaagatttgagtttggaggtactgatctaactaatttcctggctcaagaacttggcaagtccaatccacaagtaaatatcagcatgtctgatgtggaaaaaataaaagagttgtactcatgctgtgctgaagatgaattagcttatcagaagaccgaatattcttgtcctgtggagaagcacacccttcctgatggacaggtgatagcaattgggagagaaagatatactgttggggaagctttattccagccatgtctactgggtttagaggctcatggcattgttgatcagcttgtccgtgctatttcaactgtgtcatctgataatcaacgacagctgctggaaaatactgtggtttgtggtggcacttcttctatgacaggttttgaagagagatttcagaaggaatctagcttaagttcatctgctgttcaacctaccctcgttaagcctccagaatacatgccagaaaatttaaccatgtattctgcatgggtgggaggtgccatacttgccaaagtggttttccctcaaaatcagcatataaccaaggcagactatgatgaaaccggaccttccattgttcatcggaaatgcttctga

SEQ ID NO: 400 - protein, 361 aa, Glycine max
MEAAVVDVGSKLLKAGFAIPDQTPAMIIPTQMKQLLDDGSVADNSLADNVTVDPVVRGFIRDWDAIEDLLHHVLYTGLGWEIGNEGQILFTDPLCTPKANKEQLVQLMFETFNISGFYASEQAVLSLYAVGRISGCTVDIGHGKIDIAPVIEGAVHHIASRRFEFGGTDLTNFLAQELGKSNPQVNISMSDVEKIKELYSCCAEDELAYQKTEYSCPVEKHTLPDGQVIAIGRERYTVGEALFQPCLLGLEAHGIVDQLVRAISTVSSDNQRQLLENTVVCGGTSSMTGFEERFQKESSLSSSAVQPTLVKPPEYMPENLTMYSAWVGGAILAKVVFPQNQHITKADYDETGPSIVHRKCF

SEQ ID NO: 401 - DNA, 813 bp, Medicago truncatula
atggaagctgcagtaattgatgccggttccagtctcctcaaagccggatttgctattcccgatcaaactcctgccatgataattcctagtcagatgaaacgaatggttgatgaaacaaatgataatggtaatggtcagttggtggtggatgatgtcgcggttgagccagtggtaagaggttatgttagagattgggatgctatggaggatttgttgaattatgttttgtacagtggacttggatgggaaattggtaatgagggacaaatattgtttacagatccactttgtaccccaaaggctaacaaagaacagttagtgcaacttatgtttgaaacgttcaacatatcagggttttatgcctcggaacaggcagttttatcactctatgccgtgggtaggatctctggatgcacagttgacattggtcatggaaaaatagatattgctccagtaattgagggtgctgttaaccacattgcctcaagaagatttgagtttggaggtactgatctaactaatttcctggctcaagaacttggcaaatccaatccactagtgaatatcagcatatctgatgtcgagaaaataaaacagcaatactcatgttgtgctgaagatgacttagcttatcaaaagacagaagactcttgtcctgtggaaacacatacccttcctgatggacaggtgataacaattggaagagaaagatatacagttggtgaagctttattccagccaagtctattggggttagagactcatgggattgtagagcagcttgtccgtactatttcaacccgtgacatctga

SEQ ID NO: 402 - protein, 270 aa, Medicago truncatula
MEAAVIDAGSSLLKAGFAIPDQTPAMIIPSQMKRMVDETNDNGNGQLVVDDVAVEPVVRGYVRDWDAMEDLLNYVLYSGLGWEIGNEGQILFTDPLCTPKANKEQLVQLMFETFNISGFYASEQAVLSLYAVGRISGCTVDIGHGKIDIAPVIEGAVNHIASRRFEFGGTDLTNFLAQELGKSNPLVNISISDVEKIKQQYSCCAEDDLAYQKTEDSCPVETHTLPDGQVITIGRERYTVGEALFQPSLLGLETHGIVEQLVRTISTRDI

SEQ ID NO: 403 - DNA, 1083 bp, Oryza sativa
atggaggcggtggtcgtcgacgcggggtcgaagctgctcaaggccggcatcgccttgcccgaccagtccccatcgctggtgatgccgtcgaagatgaagttggaggtagaggacggtcagatgggcgacggcgcggtggtggaggaggtggtgcagccggtggtgcgtggcttcgtcaaggactgggacgccatggaggacctgctcaactacgtcctgtacagcaacattgggtgggagattggggatgagggccagatcctcttcacagagccgctcttcacacccaaggcacttcgggagcaactggcgcaacttatgttcgaaaaattcaatgtttcaggcttttatgactctgagcaggctgtattgtcactttatgcagttggacgcatttcgggctgtacagtggacattgggcatgggaaaatcgatattgctccagtttgtgaaggtgctgttcagcacatagcatcaaagagatttgatattggaggaactgacttgacaaacctatttgcggaagaactcaaaaaatctaactcatcggtaaacattgatatttctgatgttgagcggctgaaagagcagtatgcatgctgtgcagaagatcaaatggcctttgaagctataggaagctcatgccgaccagaaaggcacacacttccagatgggcaggttataacaattgaaaaagaacggtacattgttggtgaagctttatttcaaccccacattttgggcttagaagattatggaattgttcatcagctggttacaagcgtctcgaatgtcacaccagagtaccatcgtcagctgcttgaaaacactatgttatgtggtggcactgcatcaatgactggttttgaagacaggttccagagagaagcaaatctgtctgcttcagcaatctgcccatctcttgtaaagcctccagaatatatgcccgagaacctagctaggtactcggcctggctgggcggtgcaatattggccaaggtcgttttcccgcaaaaccagcacgtcaccaagggagactacgacgagactggtccatccatcgttcacaagaagtgcttctga

SEQ ID NO: 404 - protein, 360 aa, Oryza sativa
MEAVVVDAGSKLLKAGIALPDQSPSLVMPSKMKLEVEDGQMGDGAVVEEVVQPVVRGFVKDWDAMEDLLNYVLYSNIGWEIGDEGQILFTEPLFTPKALREQLAQLMFEKFNVSGFYDSEQAVLSLYAVGRISGCTVDIGHGKIDIAPVCEGAVQHIASKRFDIGGTDLTNLFAEELKKSNSSVNIDISDVERLKEQYACCAEDQMAFEAIGSSCRPERHTLPDGQVITIEKERYIVGEALFQPHILGLEDYGIVHQLVTSVSNVTPEYHRQLLENTMLCGGTASMTGFEDRFQREANLSASAICPSLVKPPEYMPENLARYSAWLGGAILAKVVFPQNQHVTKGDYDETGPSIVHKKCF

SEQ ID NO: 405 - DNA, 1089 bp, Physcomitrella patens
atggagccggctgtgctcgactcaggatcgatgtacctgaaggcgggctttgctatccccgaccaagacccgtctataatccttccgacatcaatgacgagggtggaggaggatggggtgcatggtaacgatggcgttattggggacattatacatccaattgagcgaggaataattaaagactgggatgcaatggaagacctgtggcgctatactttctacaccggccttggttgggaacctggcaacgaaggacagcttcttgttgccgaacctttgttgactcctaaggtctcacgcgagagaatggttcagacaatgttcgagactttcaacgttggtggtctttatgcagtggagcaggctgtgctctctctttatgctgtaggccgcattactggtgtcgttattgatgctgggcatggaaagatagatattgctcctgtatgggaaggggccatacagcacaatgctgtgaagcgttttgaaatttctggtcaggatcttaccgatttccttgcgaaagagcttgcacggtcacaacctgatgtgaagttagaccttgccactgtggagatgcttaaggaaaaatatgcggcggttgctgaagactcatcagcttatgtcgcgactgctgaagcctgtcctaagatacaacacacacttcctgatgggcaggttatttctgttggtagagaaagatacgatgtcggcgaagctctgttacggccttctatctttggaatagaagaagatggtctggctgaacagttgcttcgcagcgtatcaacgtgttccccttctgagaatcagcggcagcttattgaaaacatcgttttgtgtggaggcacctctatgataaggggtttggattcacgatttcagaaggaggccgttctagtggcgaatccttcagtgcgaccgtcattgattaagccgcccgagtacatgcctgacaatactttgatcaattctgcatggatgggtggagcaattctcgccaaagttgtctttcctcagaatcagcacatcaccaaagctgagtacgatgaagctggccctccaattgttcaccggaagtgcttttga

SEQ ID NO: 406 - protein, 362 aa, Physcomitrella patens
MEPAVLDSGSMYLKAGFAIPDQDPSIILPTSMTRVEEDGVHGNDGVIGDIIHPIERGIIKDWDAMEDLWRYTFYTGLGWEPGNEGQLLVAEPLLTPKVSRERMVQTMFETFNVGGLYAVEQAVLSLYAVGRITGVVIDAGHGKIDIAPVWEGAIQHNAVKRFEISGQDLTDFLAKELARSQPDVKLDLATVEMLKEKYAAVAEDSSAYVATAEACPKIQHTLPDGQVISVGRERYDVGEALLRPSIFGIEEDGLAEQLLRSVSTCSPSENQRQLIENIVLCGGTSMIRGLDSRFQKEAVLVANPSVRPSLIKPPEYMPDNTLINSAWMGGAILAKVVFPQNQHITKAEYDEAGPPIVHRKCF

SEQ ID NO: 407 - DNA, 1092 bp, Populus trichocarpa
atggaggcggcggtgatagacgctggtactcagctccttaaagccggcaccgcagttccagatcaagctccgcccatgataattccgagccaaatgaaacgaatggtggaagatggaacatcgggtgataataatgaatccgtatttgaggatgtaactgtcgatcctgttgttcgaggttatataagagattgggatgcgatggaagatttgttgcattatgttttatacactagtcttggttgggaagagggaaatgaaggccaagttttgtttaccgatcccctttgcactcccaaggctgttagagaacaattggtacaattgatgtttgagacatttaatgtttctgggttttatgcgtcggagcaagcggtgttgtctctttatgcagttgggcgtatctctggatgcaccgttgatatcggtcatgggaagattgatattgcaccagtacttgaaggtgctgttcagcacattgcttcaagaagatttgaaattggtggtgttgatttgacgaagttacttgcccaagaactgggtaaatctaatcttttggtgaatctcaatgcatctgatgttgagatgttaaaagtaaagtactcctgttgtgctgaagacgagcttgcttacgagaagactcaaaggtcaagtgatacagaggagcatacccttcctgatggacaggtgattagaattagaagagaaaaatatacaattggtgaggcattatttcaaccatctatactgggtatagaggcacttggaatagttgagcagcttgtacgtagtatttcaactgtttcttcagagaaccaccgccaactgctggaaaatactgtactttgtggtggcataacttctatgcctggttttgaagataggtttcagaaagaagcaagcctgtgctcatcagctattcgtccttcacttgtaaagcctccagaatatatgcccgataagttgacagagtactctgcatgggtgggaggtgccatactagccaaagttgtgttccctcagaatcagcatgttaccaagggagattacgatgaaactggaccatccattgtccatcggaaatgcttttga

SEQ ID NO: 408 - protein, 363 aa, Populus trichocarpa
MEAAVIDAGTQLLKAGTAVPDQAPPMIIPSQMKRMVEDGTSGDNNESVFEDVTVDPVVRGYIRDWDAMEDLLHYVLYTSLGWEEGNEGQVLFTDPLCTPKAVREQLVQLMFETFNVSGFYASEQAVLSLYAVGRISGCTVDIGHGKIDIAPVLEGAVQHIASRRFEIGGVDLTKLLAQELGKSNLLVNLNASDVEMLKVKYSCCAEDELAYEKTQRSSDTEEHTLPDGQVIRIRREKYTIGEALFQPSILGIEALGIVEQLVRSISTVSSENHRQLLENTVLCGGITSMPGFEDRFQKEASLCSSAIRPSLVKPPEYMPDKLTEYSAWVGGAILAKVVFPQNQHVTKGDYDETGPSIVHRKCF

SEQ ID NO: 409 - DNA, 741 bp, Solanum lycopersicum
atggaggcagtagtagtggatgctggttctaaatttctcaaagctggtttcgctattccagatcaaactcctgctatggtaataccaacccaaatgaaacgcattgctgaagatgatgaaggttccttgtttgaggaggaggaagtggctgtggatcccattgagaggggtttcgttaaagattgggatgcaatggaagacctgttgcatcatgttctttattctggtcttggttgggaaattggaaatgaaggtcaaattttgttcactgacccgctctgcactcccaaggctattagggaacaattggtgcagttgatgtttgaaacattcaacatctcggggttttatgcctctgagcaggcagtactgtcgctttatgcagttggacgcatatctggctgtactgttgatgttggtcatgggaaaattgatattgcacctgtcattgagggtgctgttcagcacatagcatcaagaaggttggaagttgggggattggatttgacaaagctactagcagatgagcttagtaaatcaaatcccacagtgaaactcaatatttctgatgttgaaaaattgaaagagcagtatgcatgctgtgctgatgatgatattgcctatgagaagcttcaacactcttgcctgcaagagaaacatactctgcctgatggccacggtaatcacaattggaaaagaagatacactgttggagaggcattgtttcaccatctatattag

SEQ ID NO: 410 - protein, 246 aa, Solanum lycopersicum
MEAVVVDAGSKFLKAGFAIPDQTPAMVIPTQMKRIAEDDEGSLFEEEEVAVDPIERGFVKDWDAMEDLLHHVLYSGLGWEIGNEGQILFTDPLCTPKAIREQLVQLMFETFNISGFYASEQAVLSLYAVGRISGCTVDVGHGKIDIAPVIEGAVQHIASRRLEVGGLDLTKLLADELSKSNPTVKLNISDVEKLKEQYACCADDDIAYEKLQHSCLQEKHTLPDGHGNHNWKRRYTVGEALFHHLY

SEQ ID NO: 411 - DNA, 1089 bp, Triticum aestivum
atggaggcggtggtggtcgacgcggggtccaagctgctgaaggccggcatcgcgctgcccgaccaggcccccgggctggtgatgccctcgaagatgaagacggaggtggaggagagcgaggtggccgacggcgcggcggcggtggtggaggaggtggtgcatccggtggtgcgcggcttcgtcaaggactgggacgccatggaggacctgctcacctacgtcctctacaggaacatcggctgggagatgggggacgagggccagatcctcttcaccgagccgctcttcacgcccaaggctctccgggagcaattagtgcaacttatgttcgaaaaattcaatgtatcagggttttatgattctgaacaggctgtattgtccctttatgctgttggtcgcatttcgggttgtacggttgacattggacatgggaaaatagatattgctccagtttgtgaaggtgctgttcagcacgtagcgtcaaagagatttgagattggaggaactgacttgacaaacctatttgcgcaagaactaaagaagtccaacccatcagtaaacattgatatttctgacgttgagaggctgaaagagcagtatgcatgctgcacagaagatcagttagcctttgaagctatagcgagtacatgccagccagaaactcacactcttccagatggacaggttataacaattgaaaaagagcgctatatagttggtgaagctttgtttcaaccaagtatcttgggcttagaagattatggtattgtccaccagctaattactagtgtttcaaacgtcgcatcggagtaccaaaagcaagtgctcgagaacactatgctatgtggtggcactgtatctatgactggtttcgaggacaggtttcagagagaagcgaatctgtcggcttcggcgatccgcccgactcttgtgaaggccccggagtacatgccggaggacctggcgcggcactcggcgtggctgggcggcgcgatcctggccaaggtggtcttcccccagaaccagcacgtgaccaagggcgactacgacgagacgggcccgtccatcgtccacaagaagtgcttctga

SEQ ID NO: 412 - protein, 362 aa, Triticum aestivum
MEAVVVDAGSKLLKAGIALPDQAPGLVMPSKMKTEVEESEVADGAAAVVEEVVHPVVRGFVKDWDAMEDLLTYVLYRNIGWEMGDEGQILFTEPLFTPKALREQLVQLMFEKFNVSGFYDSEQAVLSLYAVGRISGCTVDIGHGKIDIAPVCEGAVQHVASKRFEIGGTDLTNLFAQELKKSNPSVNIDISDVERLKEQYACCTEDQLAFEAIASTCQPETHTLPDGQVITIEKERYIVGEALFQPSILGLEDYGIVHQLITSVSNVASEYQKQVLENTMLCGGTVSMTGFEDRFQREANLSASAIRPTLVKAPEYMPEDLARHSAWLGGAILAKVVFPQNQHVTKGDYDETGPSIVHKKCF

SEQ ID NO: 413 - DNA, 1083 bp, Zea mays
atggaggcggtggtcgtcgacgcgggctctaagctgctcaaggccggcatcgcggcgcccgaccaggcacccccactggtaatgccgtcgaagatgaagctggatgttgaggaccaggagatggctgacggcgcggtggtagaggaggtggtgcaccctgtggtgcgcggcttcgtcaaggactgggacgccatggaggacctactcaactacgtcctgtacagggacattgggtgggagattggggacgagggtcagattctcttcaccgaacccctcttcacgccaaagactcttcgggagcaattggtgcagcttatgtttgaaaagttcaatgtttcaggcttttatgcctctgaacaggctgtattgtcactctatgctgttggacgcatttcaggatgtaccgttgacattggtcacgggaaaatagatattgctccagtttgtgaaggagctgttcaacacatagcttctaagagattagagattgggggagttgacttgacaaacctgtttgcacaagaactgaaaaaatccaacccatcagtaaaccttgatgttgctgatgttgagctgctgaaagagcagtatgcgtgttgcacagaagattatttgacttttgaaagtatagaaagctcttgccaaccagaaaaacacactcttcctgatgggcaggttataacaattgaaaaagaggggtacattgttggtgaagctttatttcaaccacgtatattgggcttggaagattatggtatcgttcaccagctagtcactagtgtctcaaatgtttcatcagagtaccatcgtcagctgcttgaaaataccatgttatgtggtggcacctcatcaatgactggctttgaggacaggttccagagagaagcaaatctgtctgcttcagcaatctgtccatcacttgtgaagcctcctgaatacatgcccgagaacctagcaaggtactcggcctggttgggtggtgcgatattggctaaggtcgttttccctcaaaaccagcatgtgaccaagggcgagtatgatgagacggggccgtccattgtgcacaagaagtgcttttag

SEQ ID NO: 414 - protein, 360 aa, Zea mays
MEAVVVDAGSKLLKAGIAAPDQAPPLVMPSKMKLDVEDQEMADGAVVEEVVHPVVRGFVKDWDAMEDLLNYVLYRDIGWEIGDEGQILFTEPLFTPKTLREQLVQLMFEKFNVSGFYASEQAVLSLYAVGRISGCTVDIGHGKIDIAPVCEGAVQHIASKRLEIGGVDLTNLFAQELKKSNPSVNLDVADVELLKEQYACCTEDYLTFESIESSCQPEKHTLPDGQVITIEKEGYIVGEALFQPRILGLEDYGIVHQLVTSVSNVSSEYHRQLLENTMLCGGTSSMTGFEDRFQREANLSASAICPSLVKPPEYMPENLARYSAWLGGAILAKVVFPQNQHVTKGEYDETGPSIVHKKCF

SEQ ID NO: 415 - DNA, 1593 bp, Brassica napus; identical to SEQ ID NO: 353

SEQ ID NO: 416 - protein, 530 aa, Brassica napus; identical to SEQ ID NO: 354

SEQ ID NO: 417 - DNA, 1596 bp, Glycine max
atgtcgctgaggccgaatgctagaaccgaggttcgccgcaaccgctacaaggtggcggtggacgccgacgagggtcgccggcggagggaggacaacatggttgagatccgcaagagcaagcgcgaagagagcctccagaagaagcgccgcgaaggcctccaagctcagcagcagttccccactcctctccaagcctcctccattgtcgagaaaaagttagagagtcttcctgcgatggtagctggagtgtggtcggatgataacagccagcaattggaagcgaccacgcagttccggaaactgctttcgattgagcgcagtcctccgattgaggaagttattcaagctggggttgtgcctcggtttgtggagtttcttgttagggaggattttcctcaactacagtttgaggctgcgtgggctctcacgaacattgcatctggaacttctgagaataccaaggtggtgattgatcatggggcggtgccgatatttgtcaaactacttagttcgcccagtgatgatgttcgggagcaggcagtatgggcgttgggaaatgttgctggtgactccccaaggtgtcgtgatcttgttcttagtcacggtgccctgatcccattgttggcccagttgaatgagcatgcaaaactttccatgttgagaaacgccacatggaccctttcaaacttctgcaggggcaagccacagcctccatttgagcaggtgagggcagcgcttcctgctctagaacgattggttttttccaatgatgaagaagtcttgacagatgcatgctgggcgctatcatatctttccgatggaacaaatgacaaaatccaagccgttattgaggctggtgtttgtcccagactggtgcagctccttctgcacccatccccttcagtgctgattcctgctcttcgcacagttggaaatattgtgacgggagatgatatgcagactcagactatcatcaatcatggtgcgctcccatgcctcttgagcctgttgacacacaatcataaaaaaagtatcaagaaagaagcatgctggaccatatcaaacattacggctggaaacagagatcagatacaggctgttattgaagctggtctgattgccccccttgtcaatcttcttcaaaatgctgaatttgacataaaaaaagaagctgcttgggcaatctcaaatgctacatctggcggtacccatgagcagatcaagtatttggtgagccagggttgcatcaagcctctctgtgatctgcttgtttgccccgacccaagaattgtcactgtctgtttagaaggtcttgagaatattctgaaggttggggaagctgagaagagcttgggtaatactggagatgtcaacttgtatgctcagatgatagacgaagcagagggattagagaaaattgaaaacctgcagagtcatgacaacaatgaaatatatgaaaaggctgttaaaattcttgagacatactggttggaagacgatgatgagacactacctgcaggcgatggtgctcaacccggttttaattttggaaacaatgatcttccggttccatctggtggattcaactttagttga

SEQ ID NO: 418 - protein, 531 aa, Glycine max
MSLRPNARTEVRRNRYKVAVDADEGRRRREDNMVEIRKSKREESLQKKRREGLQAQQQFPTPLQASSIVEKKLESLPAMVAGVWSDDNSQQLEATTQFRKLLSIERSPPIEEVIQAGVVPRFVEFLVREDFPQLQFEAAWALTNIASGTSENTKVVIDHGAVPIFVKLLSSPSDDVREQAVWALGNVAGDSPRCRDLVLSHGALIPLLAQLNEHAKLSMLRNATWTLSNFCRGKPQPPFEQVRAALPALERLVFSNDEEVLTDACWALSYLSDGTNDKIQAVIEAGVCPRLVQLLLHPSPSVLIPALRTVGNIVTGDDMQTQTIINHGALPCLLSLLTHNHKKSIKKEACWTISNITAGNRDQIQAVIEAGLIAPLVNLLQNAEFDIKKEAAWAISNATSGGTHEQIKYLVSQGCIKPLCDLLVCPDPRIVTVCLEGLENILKVGEAEKSLGNTGDVNLYAQMIDEAEGLEKIENLQSHDNNEIYEKAVKILETYWLEDDDETLPAGDGAQPGFNFGNNDLPVPSGGFNFS

SEQ ID NO: 419 - DNA, 957 bp, Gossypium hirsutum; identical to SEQ ID NO: 355
  misc_feature (653)..(653): n is a, c, g, or t
  misc_feature (737)..(737): n is a, c, g, or t

SEQ ID NO: 420 - protein, 318 aa, Gossypium hirsutum; identical to SEQ ID NO: 356
  misc_feature (218)..(218): Xaa can be any naturally occurring amino acid
  misc_feature (246)..(246): Xaa can be any naturally occurring amino acid

SEQ ID NO: 421 - DNA, 1575 bp, Hordeum vulgare; identical to SEQ ID NO: 235

SEQ ID NO: 422 - protein, 524 aa, Hordeum vulgare; identical to SEQ ID NO: 236

SEQ ID NO: 423 - DNA, 1686 bp, Medicago truncatula; identical to SEQ ID NO: 237

SEQ ID NO: 424 - protein, 561 aa, Medicago truncatula; identical to SEQ ID NO: 238

SEQ ID NO: 425 - DNA, 1581 bp, Oryza sativa; identical to SEQ ID NO: 363

SEQ ID NO: 426 - protein, 526 aa, Oryza sativa; identical to SEQ ID NO: 364

SEQ ID NO: 427 - DNA, 1599 bp, Physcomitrella patens; identical to SEQ ID NO: 365

SEQ ID NO: 428 - protein, 532 aa, Physcomitrella patens; identical to SEQ ID NO: 366

SEQ ID NO: 429 - DNA, 1590 bp, Populus trichocarpa; identical to SEQ ID NO: 367

SEQ ID NO: 430 - protein, 529 aa, Populus trichocarpa; identical to SEQ ID NO: 368

SEQ ID NO: 431 - DNA, 1590 bp, Solanum lycopersicum; identical to SEQ ID NO: 245

SEQ ID NO: 432 - protein, 529 aa, Solanum lycopersicum; identical to SEQ ID NO: 246

SEQ ID NO: 433 - DNA, 978 bp, Triticum aestivum; identical to SEQ ID NO: 371
  misc_feature (885)..(885): n is a, c, g, or t

SEQ ID NO: 434 - protein, 325 aa, Triticum aestivum; identical to SEQ ID NO: 372

SEQ ID NO: 435 - DNA, 963 bp, Zea mays
atgtcgctgcgtccgagcgagcgggtcgaggtacggcggaaccgctacaaggtggcggttgacgcggaggaggggcggcggcggcgcgaggacaatatggtggagatccgcaagagccgccgtgaggagagcctcctcaagaggcgccgtgaggggctccaggcccaggtccctgcccctccctccggggtcgagaagaagcttgaaagcctcccagctatggttagtggggtttattcggatgataataaccttcagcttgaggccaccacacagttccgcaaattgctctctatagagaggagtccccccatcgaagaagttatcaaaacaggtgtagttccaagatttgtgcagtctctcaccagagaggatttcccccagctgcagtttgaagctgcatgggctctcacaaatattgcttctggcacttcagaaaatacaaaggttgttattgatcatggagctgttcctatatttgtgaagcttcttgggtctggtagtgatgatgttcgtgagcaggctgtgtgggctttgggtaatgttgctggcgattctccgaagtgccgcgaccttgttcttgccaatggtgcgttgatgcctctgctagcccagttgaatgagcatgctaagctctccatgctgcggaatgccacctggactttgtctaacttctgcaggggaaaaccacagccatcatttgatcagactaagcctgctctgccagcacttgcacgacttatccattccaacgacgaggaagttctcactgatgcatgctgggccctgtcatacttatctgacggcactaatgataagatccaggctgtgattgaagctggtgtttgcccccggcttgtggagctcctcctccatccatcaccatcggtgcttatacctgctctacgaactgttgggaacattgtaactggagatgatcagcaaactcaggtggggctttaa

SEQ ID NO: 436 - protein, 320 aa, Zea mays
MSLRPSERVEVRRNRYKVAVDAEEGRRRREDNMVEIRKSRREESLLKRRREGLQAQVPAPPSGVEKKLESLPAMVSGVYSDDNNLQLEATTQFRKLLSIERSPPIEEVIKTGVVPRFVQSLTREDFPQLQFEAAWALTNIASGTSENTKVVIDHGAVPIFVKLLGSGSDDVREQAVWALGNVAGDSPKCRDLVLANGALMPLLAQLNEHAKLSMLRNATWTLSNFCRGKPQPSFDQTKPALPALARLIHSNDEEVLTDACWALSYLSDGTNDKIQAVIEAGVCPRLVELLLHPSPSVLIPALRTVGNIVTGDDQQTQVGL

SEQ ID NO: 437 - DNA, 246 bp, Brassica napus
atggattatgatgacagtgactttcaaaaccacaatctccatttagctggtgaagctaacactaagtttcctccggtgtctcttccaaggtttgattttgacgagaggtttgatagtttagtcgaaactgagggttttcttggtattgagggtaacgaagatagtaactggattgaggatttctctcgtggaagtagtggtgtaggtgttaagctcagctgcaacagagtcttgtgccatttctag

SEQ ID NO: 438 - protein, 81 aa, Brassica napus
MDYDDSDFQNHNLHLAGEANTKFPPVSLPRFDFDERFDSLVETEGFLGIEGNEDSNWIEDFSRGSSGVGVKLSCNRVLCHF

SEQ ID NO: 439 - DNA, 2418 bp, Glycine max
atgattgtacgattggggaatagggattcacccatggattatgatgacaatgattttcaaaaccagaatctccatttagctggtgaagggagtgccaaatttcctccagtattaaggccatatgctctcccgaagtttgattttgatgaaagccttcaagcaaatttaagatttgatagtttagtagaaactgaagtttttcttggcattgaaagtaacgaagataaccagtggattgacgcattctcccgagggggtagtggcatagagttcagttcaactgcagccgagtcttgctctatatcaaggcatggcaatgtttggtctgaggcaacttcctcagaatctgttgaaatgcttttaaaatctgttgggcaggaggactatattcctagacaaacagttattcaggaatcagatgcctgtgatgaactggcctgcttagctaagcaaatggacaccaatccaaaatttgatgataaaaatgaatttagaagtagtgtttcagatttacatccacctggtggtatccatactggtttttctggattgaaagaggatgtaggaatggagaagcctcatggtggagtctcccaaggtcatgaaggggaatcatccattgatggaacttcaagtaaccccaaactaagtgatatctgcagaaatattgacttgcctgtgtctgaggggagtctgactcttgataccaatgacaaaaataacaatacaaaccaaagagaagttgagactgttgatgatgactcacatcatggcaaaactcaagatgattcatctgcagtgcaaactaatattgctgaatcatctataaaaaatatgggtgatgacaagagagatcctttacaagcacaaacttataatcaagatttggaatcttctctgatggataaagaagctgttgtggacacacaaactctggatcgagacatggttgggagtgatgcacatcatctggataaacccctttgttcaatccccacagaagaaaatttggaagggggtgtagttgaaggtcttgagactgggttaagtagtttagagggttccttaacaatggaatctgttgctgcttctggctcgccgaaagttgaaaaaaccagtgaagatatgtgtttcagtgctctgtctcagaacaatgtaagtgaagatgtaatgttgcttaacgatgtggaaatggatgaccagtctgcaccaaatacatgtgtattgccaaaatcttcaagtaaagatgattctatctcggaggggcaagcagttgaggttagtaatttaaattgtgaaaattgtccaaatatgcaccagaatgtggatgtcatagagaagacgacacatggcggcagcagtgttactaaggaagatgagctattgaacactggtgatcatgtggatacagtgattttgtcaagcaagtcagagacatctatgcctactgcagaagaaagtaacatttccactattaatgaaggaaatagtgacaatatggtaggaagtttttcaagtagcagtgcgacggccttttcaacaaaatcttccattttgggtgagtctactcaaatatgtgtaaacaatgaacctgacagacagaatgaccatgaaaaatgtgatctagatgtctctgtcaatgatcaggatgaactaatgaacactggtgatcatgtggatacagttatattgtcgaacaagtcagaggcatctatatttacttctgaggaaaataacatttcctccatccgtgaaggaaacagtggcaaaaaggtagaaggttttcctagtggcagtgtgaaggatttttcaacaaaatcttccattttgggcaagtctactcaaatatgtgcaaacaatgaatctgacagacagaatgaccaggaaaaatgcgatcaagttgtctctgtcaatgatcaggagcatgaaaaggttccttctgattctagccagaagcattgtgatgtcgataagggtgttgtttcatcatctattagtgaaggtagcatggaaatcaagttgatggattatgatgacaatgattttcaaaaccagaatctccatttagctggtgaagggagcgccaaatttcctccggtattaaggccatatgctctccccaagtttgattttgatgaaagccttcaagcgaatttaagatttgatagtttagtagaaactgaagtttttcttggcattgaaagtaacgaagataaccagtggattgacactttctcccgagggggtagtggcatagagttcagttcaactgcagctgagtcttgctctatatcaaggcatggcaatgtttggtctgaggctacttcctcagaatctgttgaaatgcttttgaaatctgttggacaggaggactatattcctagacaaacagttattcaggaatcaagatgcctgtga

SEQ ID NO: 440 - protein, 131 aa, Glycine max
MDYDDNDFQNQNLHLAGEGSAKFPPVLRPYALPKFDFDESLQANLRFDSLVETEVFLGIESNEDNQWIDTFSRGGSGIEFSSTAAESCSISRHGNVWSEATSSESVEMLLKSVGQEDYIPRQTVIQESRCL

SEQ ID NO: 441 - DNA, 4911 bp, Medicago truncatula
atggattatgatgacaatgattttcaaagccagaatcttcatttagccggtgaagggagtaacaaatttcctccagtattaaggcaataccccaagtttgattttgatgaaagccttcagggtcatttaaggtttgatagtttggttgatactgaagttttccttggcattgaaagcaacgaagataatcagtggattgacgcatactcccgggtaagtagtggcacagagttcaattcaactgcagctgaaacttgctctacgtcaaggcataataatgtttggtctgaggcgacttcctcggaatctgttgaaatgttattaaaatctgttgggcaggaggacattatccccaaagaagctattgttatagaagagtcagatgcctgtgatgaattagccaagcaaatggatcccaatcaaaaacctgatgagaaaattgagtttaaagataacattactgatacacagccacccagttgtattcatgaaagcttgtccagatcaaaagaggatgtagaaatggagcagtctctggccggagtttcccaaggccgtgaaggtgaatcatccatagatggaagtttaaataatatgaaaccacctgatatgcatcgcaatattgacttgcctgagtctggggggattctctttgatacaaaccaaaggaaagttgaagttccagctgatggttctgtacatgaaaaaactaacgataactcatctgcttccgtggcgatgactaatacgaatgaagcttctacagaaaatatctctacctgtgaagtcttaaaaattcaaaatgtgcaaaatcaaatagttggcctgggtgacgacgaccaaagttctttacaaacacaaattagtaagcaggatttggagtcttccgtgaacatcaaagattttaatgctggcactcaaactttagatgtaaatacagttgagggtgaagcaaatcattctgataacccacctcgtttaatccatacggaacaagctttggaaggtgagagtgtagttgaaggccttgcgactgggataaatactttagagaaatccttgaacaccgtatctaatggtatttctaacctgcagaaaacagaaagaggaagtgaagatgcatgttttagagatttatcccagggaaatgcaaatatagattcattattggttaaagatcctgcggtggataaccaatctacaccaaatacaagcaacatgccaatgattgcaataaacgataattccagttctgaggggaaagatgcatgttttagagatttatcccaaggaaatgctaataacgatgctctattgattaaaggtcctctgacggatgatcaatctgcactaaatacaagtggcattccaaagattgccatactagatgattctagttctgaggtgcataaagttgaggtcagtaattctgattgtggaacttgtcctaattatcagccgaatacggtgatgattgagaagacatttggtgagagcagtgtttgtaaggagaaggagttggtaaacattggtaaccagatggatacagaggatttgttaggtaagtcagaggcatctatgcttgctgtggtggacaaaaacacttctatagccagtgaaggaaatagtgataacagagcaagttttttcactttcaatacaatggtttctacagagtctcacattttgggcgagaccactcaagtatgtgaaaataacaaatctgacgagcataaagatttttgtcaagacatttttgtcattgaccaagggcgtgaaaaggctccttttgattcgagcacaattccttgtgatgttgatcaattccatcttgctgacaagagagtttgttcatcatctcttggtgcaggtagtgttgaaacctccacagtatcggtcgatgtcacgccggtcaacagttcagatcaccatgagcttgaaaggatgaagcatgttgagcctgcttctgttgatgaaaaggaagactttgaagccaaagtagatgaagaagcaggtgattcttttcctgttgggtcttctgaactggaagttgatccctgtcctgttgctggaactaaaagtaaaaaaaattccgataatctggataatctgcatattactgctactaaaaagattggtgaacctcaagaaagacaaagtagtgaggttgatcacgagtgcacaaaagattctagtatggctactgatctatgtgaatcactagagaaacagggtgatgaagttactgtttgttttattaaggatgataaggaggcaatgtctgacactagggattcacccatggattatgatgatagtgattttgaaagccagaatcttcatttagctgctgaagggaacaccaaatttcctccagtatatgctctccctaagtttgattttgacgaaagccttcaatcaaatttaagatttgatagtttggttgagactgaagtttttcttggcattgaaagtaacgaagataaccagtggattgacgacacattttcccgtgcgggtagtaacatagagttcaattcaactgctgctggatcttgctctatatcaaggtatggcaatgtgtggtccgaggctgcttcctcagagtctgttgaaatgctcttaaaatctgttggacagggggagtatattcctaggcaaactcgggaatcgggtgcttgtgatgaactggcctgcttagctaagcaaatggactccaattctaaacccgatgatagaaatgaatttaataataatgttacaaatttacagccaccttttgatacacatacaagtttttctggattgaagaaacatgtaggaatggagcagtctcagacaggaatttcccaaagtcatgatggtgaattttccttcgatggaagttcaggtattccggaaccaaatgacatgttccgaaatattgacttacctatggctgagggtagtccaactctctttacaaatgataaaagtaacattactaaccaaagagaagttgagactgtggctgatgtctcagatcatggtgaaactcacgattcatcagcacttgtggtggaaactaatattactgaatcatctctgcaaaacattgacctgcctatgtctgagggtagtccaactatctttaccaatgataaaagtaacattagtaaccaaagcgaagttgagactgtggctgatatctcgggtcatggtgaagctcatgattcgtcagcactagtggcggaagctaatattactgaatcatctgtgcaaaatatggttgatgagcaacaaggttcacaacaagcacaaactaataatcaaaatgtggaatcttctatgatgaaggaggaagctgttgtagacacacagactctggatcaaaatgcagctagtgttgatgcacatcatccggataaatctctttttccaacacccccacaagactctttagaaggagggagtttagcgaaaggaccggagaccgggttaagtagtttagaggattccatgggaataagaaccgttgcagtttctgacatgcagaaagaagaaagatgcagtgaagacatatgttcccgtgatctgtctcaggaaaatccaagtgaaaacttagttttgcttaaagatgcggaaatggaggatcagtccgtaccagatacttgcatatcaccaaaggtttcagttaaagatgattctttctctgccgggcaggtgattgaggatagcaagtccagtcatggaatttgtcccaatctccagcaaactgtggatgtcattgagaacaaaacttacagtgcaagcaatgttcttaaggaaaatatttcattaaacactggtgaccacatggattcagggattttatctagcaagttggagtcatctatgtttcctgcagaggaaaatagcatttctattgttagtgaaggaaataatgacaacagggttggaggtttttccagtttcagtttggtggcttcttcaagaaactcttccattgtgggtgaatcgactcaaacatgtgtaaacaatgaacctgataggcaaagtgacccagaaaaatttgaccaagatgtttctgtcaatgatgaaaagaatacaaagattctttctgattctagccaaatgcattttgatgttgcccaatcccatcttggtgataagggagttgtttcatcgcctcttagtgcaggtagcatggaatctgagttgacaacttccactgtatcaatcaacgtcaaacctgcctataattcagcatcgcaaattatttcagaaaatactagtttgacatcctgtgagatgatgaatgatccacctcctagtgaagttgtttcaattcatcgagcgactggtgacaacgatattcaaagggtaactaccgttgaatcaccttctgccgagggaaaagaagaaattgaaatgacaataacagagaaagctggaatatcggctcttgttgggtcttctgaacaggaaactgctccttctcctgttaaggaaacagaaaaacttcatccttctggtactactggacatttgaaatgtgacttgacagtaacagaggaagctggaatatcggctcttgttgggtcttctgaacaggaaactgctccgtgtcctgttaaggaagcagaaaaacttcatccttctggtactaccggacattttatatgtgacatagcaagtgacagtaggcctgatgttgcgactcatggtgctgcaaaaattggggaaccgcaaagaacaacaaatgagaaggttaccgaggaatgcacaaaagatattagtatgcctccagttctatgtgaatcatcagagaaacagggtgacggtgtcataatttctgttattaagaatgataaggagactttacaagaggttcatgaaaagtcgtcctcgaaagaattaggtaaccactaa

SEQ ID NO: 442 - protein, 877 aa, Medicago truncatula
MSDTRDSPMDYDDSDFESQNLHLAAEGNTKFPPVYALPKFDFDESLQSNLRFDSLVETEVFLGIESNEDNQWIDDTFSRAGSNIEFNSTAAGSCSISRYGNVWSEAASSESVEMLLKSVGQGEYIPRQTRESGACDELACLAKQMDSNSKPDDRNEFNNNVTNLQPPFDTHTSFSGLKKHVGMEQSQTGISQSHDGEFSFDGSSGIPEPNDMFRNIDLPMAEGSPTLFTNDKSNITNQREVETVADVSDHGETHDSSALVVETNITESSLQNIDLPMSEGSPTIFTNDKSNISNQSEVETVADISGHGEAHDSSALVAEANITESSVQNMVDEQQGSQQAQTNNQNVESSMMKEEAVVDTQTLDQNAASVDAHHPDKSLFPTPPQDSLEGGSLAKGPETGLSSLEDSMGIRTVAVSDMQKEERCSEDICSRDLSQENPSENLVLLKDAEMEDQSVPDTCISPKVSVKDDSFSAGQVIEDSKSSHGICPNLQQTVDVIENKTYSASNVLKENISLNTGDHMDSGILSSKLESSMFPAEENSISIVSEGNNDNRVGGFSSFSLVASSRNSSIVGESTQTCVNNEPDRQSDPEKFDQDVSVNDEKNTKILSDSSQMHFDVAQSHLGDKGVVSSPLSAGSMESELTTSTVSINVKPAYNSASQIISENTSLTSCEMMNDPPPSEVVSIHRATGDNDIQRVTTVESPSAEGKEEIEMTITEKAGISALVGSSEQETAPSPVKETEKLHPSGTTGHLKCDLTVTEEAGISALVGSSEQETAPCPVKEAEKLHPSGTTGHFICDIASDSRPDVATHGAAKIGEPQRTTNEKVTEECTKDISMPPVLCESSEKQGDGVIISVIKNDKETLQEVHEKSSSKELGNH

SEQ ID NO: 443 - DNA, 5052 bp, Oryza sativa
atggattatgatgattctgattttcagagccagaatttccagttagctggtgaagacaacaataaattcccagcaggtctgcggcaatttccactgcccaaacttgacatcgacgaccaactacaaagccacctcagatttgataacctaattgattcagagggactttttagcggacaaggtcacggcaacagttggattgaggttttgtccactggaagtagtgttgttgattttagttctagtgctgctgaatcttgctctataaataggacaaataatgtatggtctgaggcaacatccactgaatctgtggaaatgttattgaagtcagtgggtgaaaatgagatgaccggtaacatggatgagaacgcacatcatcagattagtggaatggacagtaaaactgatccatccaacatgccgtccaaaacaagtgattctcccacaggcaacattatagtaccagctgagaatgataagtctcagagcactcgttcggaaatggcagaagatccttcaaggattcagcctcagcttgagcatatcagacctttctcagtggatgacaaagctgaacaagcagtaggttcaactttatcagacagaaaatctaactatacgctggaatctgtttctgagaggtgcatagtgagtgggaggtcttcttctccaaagaaaacatcagaaagctgtccagatgttggcagctattttgaggtggtccatgatgacgattctttggacaacctcaacatacagtcagatggagtaggttctagaaagttgaataatgaacccttctcagacttggcaccattacagaacatttatactaccagctcatatcactttgagcaggacaatcaagaatcaggagttggtgttaccactcaaggttcagaaatatgccacacgaatgaaaataaagatggacttcatgatttgcaaaatttgtcatgtacaagccagcatttgggttcttcaaacttaactagtgaagttagcaatgaaactttattgtcgggaagttctgatggattactggaggccatcacaaatccagtaaagatgctgcacaggagtgatgacactagtaagagagccagtgctacactgcaatcatctttcttacaagtcgagcatgcatcagaaggcacaaaaggttctattgacaggagcagtgagcccgccatgaagaaatttggtgctagtgaagaacccaattctgctaaatctcaaggtgagccagatttgaaaaattctagtcctcatcttgtcattcctttgccaaccataagtggtgagtttattcagtctccaaaaggaaaacagcttgctcatgttgctggagtttctgaagaaaccaaatatgacagggtggatgatacgaaccatagcactagtgatgactcaaaacttgccatgttggagcagcttcaagattctgttgataatctatctagtggtgttatggaagagaagacaatcagagggcaaatctcagctgtttcagggaacgttgtacatgtagtgaaaagtggtcattgtgaaaaagttgcagtttctaccagtacaacagatgataagtttgagtcaccgggtgatattgtgcctgacaattcttcagcttgtttacctgatgaaaaagacccaagcatcacagttaaccacgaggtgtcattcaaggaaggtgttgtgcctgcattagaagacgatcctgagaaaatgtcctcaatgaatcatgaggagccattgaaggaagatgataaatctactttagaagttggagaacacaataccacatctcctgtttctgagcccttgctgatgggatcaacaggatcagtgaatccgaacattgatactatttgtagcagtggtactgatgctgttgcagaaacaccacaatgcgaagaacaggccacttcttcgggtagtttgaccacaaatgcaactcaggataaactaggtgatcatccagacgcttgtccaccgaaagtcttgactactgggcctttgatgcaacctgaggatcatgaagatttagttgcaccatcctctgtcttgggtgcctcgtctgaaaagggtgaacaaaataacggaaaagttcccttgaatgggatggatgattcgggtgtgcagttacaagataaggtattaagtcatggtggagatcgtactcttgttactgtttcatcagagaataagaatggcttagaacatgggactggtgaaggaagctgcactgatgctacatgtggttcgcctacagtgattagttgcaatgaatcctgtccagaagaagatgggcagggcagtaatgctttgcttcatcacaaacaaaccgaaccacccaaggatcctaaagatcatacagcttcgactaacaattcccatgtctcaaaagaaggttcttccagaaatgtaaaacctactcttacttcggaggagacgcatacagccgaagataaaagtttttcatttgaggttggagctccactaaatataactgagaaagctcatgctcctgcttggagcccattgcctcgacctgaagttgctcagagtcccgaggtaaccactggaattcctaaacctggaaatccatcgaatcatggtagtgatgaaagtaagaatttggcgattgtggagaccagcaaagaacaactatctggaaggaaagtggttggaagtgctgaggggtcttctgtaagctcacatattggtcatatcactaaagccaaaagtacaccactagagcaggaacaacaacatccaactcctgatgtcaatgctttggggcaccaacctttcacagatttacagcatgtgcagctacgtgcacagatatttgtttatggagctctcattcaaggaatgccaccggcagaatcttacatggtgtcagcttttggagaacctgcatgtggtcgtaagcctccatgggggacacttttgcaagctgctttggaaagatataatagtcagaggtcatctttaactggcttggagactcctacaagctcacatataggtagccgtgtgacggaaaaagccagtagaagcacagcggttaaaactgcaccagctagcaaaaagggtggcaaaactgtgttgccagcacatactgctgtgccccttcatttgccaactttaaatatgtctcctcttggtagttctgctttgagcttgccacgaggtactcatctggattttggccaggctgtatcaccagtattcccatacagttcacagacaaggcagcctacttctggtgttgcatcgtggtttccccagagccctggtgggcgcgctgccccctggttggttcaaccacagaatttgatatttgattcatcgatgaaaccgcctgtgccggcaagtgcaaatgaaactgcaaagggagcatcctctaaaaacatatccatttcacaagctgtttcacctgttgcattccctccgaatcaggcgccttctaccatttctccattagcagtcatacctgaggaaaaacagaaggcatcggtttctacttctaagcgtggagctacaccacaaaagtcaagaaaaagaaagaaagctccagcaagtccagaacaacctatcattgcccctctgctcaaaacagatattgcatctgttactcctgccactcagcatacaccaggcttcaccttatccactcattctccaagcaatattttggccagtgggcttgtttctaacacaggcttggtcacccctgtgcctaattatcagattactggtatcaaggatgcagagcaaagaatcttttcagaacagatctctggtgcaatagagcaatcaatgggacaagcaaaaggggcaggtgtgcatgcgatggatgcagttaggcatgctgaaggtatttggagccacttatcaacaaattcgaaaggcaaattacctgcagaagtagaagagaagcttacttcagctgctgctgctgcttctgcagcagtttctgttgcaaaggcagctgctgaagctgctaagatggcctcagaggctgcattgcaggcaaaaatgatggcagaggaagtcctttcttctacctatgcaaattcctctcagaagcatgatgctggtgaatttaaagtcagtaacaacctggctagtttctcaagtttgacacccacatcgtcttggaaaacaaaggatgacatttccaagggttccattatttcagtggcacgggaggttgctagaaagagggttgaagaggcagcagcagctgcaaaacgtgcagaaaacttggatgccattctgaaagctgcagaacttgctgcagaggctgtgttcaaagcaggaaccatcattggtatgggtgaacctttaccttttacccttagtgagctgttggaagctggtcctgatggttactggaaatctgatcaagtgaggaataagaaggctacaaaattggaactacctactgattttagtaaatctggaaggaagcgtggtggcaaagctaaacatgaccatgcaatacagaacttagagccatcttctagtggcaaagggttgcagctagatgtagtgcattcagggaacgtggctgaagatgttcccaccattgctccagtcaatgggaacagaaatgatgcagcaccgaacataatctggaatggcattgaaaagggatctgctgttgaggttttagttcacaagggtgagtctggagtagcttggttttctgccaaagttcttgatataaacaatgatagtgcatgtatcagctacgactctcacactgaagaaactggtcttcgcaaagaatgggtgccattgagacaggaaggggagaaggcacctcaaatccgccttgctcatcctgcaactgtttctagatttaaaggaactaggaagcgccgtagggacacatcaggaaattactcttgggctattggtgatcatgtggacgtattgattgaagatagttggcgagagggaattatttctcgcaaccgtgatggtgatgaaacaaagcttaccgtacaattttcaggtatcatagtaatgtga

SEQ ID NO: 444 - protein, 1683 aa, Oryza sativa
MDYDDSDFQSQNFQLAGEDNNKFPAGLRQFPLPKLDIDDQLQSHLRFDNLIDSEGLFSGQGHGNSWIEVLSTGSSVVDFSSSAAESCSINRTNNVWSEATSTESVEMLLKSVGENEMTGNMDENAHHQISGMDSKTDPSNMPSKTSDSPTGNIIVPAENDKSQSTRSEMAEDPSRIQPQLEHIRPFSVDDKAEQAVGSTLSDRKSNYTLESVSERCIVSGRSSSPKKTSESCPDVGSYFEVVHDDDSLDNLNIQSDGVGSRKLNNEPFSDLAPLQNIYTTSSYHFEQDNQESGVGVTTQGSEICHTNENKDGLHDLQNLSCTSQHLGSSNLTSEVSNETLLSGSSDGLLEAITNPVKMLHRSDDTSKRASATLQSSFLQVEHASEGTKGSIDRSSEPAMKKFGASEEPNSAKSQGEPDLKNSSPHLVIPLPTISGEFIQSPKGKQLAHVAGVSEETKYDRVDDTNHSTSDDSKLAMLEQLQDSVDNLSSGVMEEKTIRGQISAVSGNVVHVVKSGHCEKVAVSTSTTDDKFESPGDIVPDNSSACLPDEKDPSITVNHEVSFKEGVVPALEDDPEKMSSMNHEEPLKEDDKSTLEVGEHNTTSPVSEPLLMGSTGSVNPNIDTICSSGTDAVAETPQCEEQATSSGSLTTNATQDKLGDHPDACPPKVLTTGPLMQPEDHEDLVAPSSVLGASSEKGEQNNGKVPLNGMDDSGVQLQDKVLSHGGDRTLVTVSSENKNGLEHGTGEGSCTDATCGSPTVISCNESCPEEDGQGSNALLHHKQTEPPKDPKDHTASTNNSHVSKEGSSRNVKPTLTSEETHTAEDKSFSFEVGAPLNITEKAHAPAWSPLPRPEVAQSPEVTTGIPKPGNPSNHGSDESKNLAIVETSKEQLSGRKVVGSAEGSSVSSHIGHITKAKSTPLEQEQQHPTPDVNALGHQPFTDLQHVQLRAQIFVYGALIQGMPPAESYMVSAFGEPACGRKPPWGTLLQAALERYNSQRSSLTGLETPTSSHIGSRVTEKASRSTAVKTAPASKKGGKTVLPAHTAVPLHLPTLNMSPLGSSALSLPRGTHLDFGQAVSPVFPYSSQTRQPTSGVASWFPQSPGGRAAPWLVQPQNLIFDSSMKPPVPASANETAKGASSKNISISQAVSPVAFPPNQAPSTISPLAVIPEEKQKASVSTSKRGATPQKSRKRKKAPASPEQPIIAPLLKTDIASVTPATQHTPGFTLSTHSPSNILASGLVSNTGLVTPVPNYQITGIKDAEQRIFSEQISGAIEQSMGQAKGAGVHAMDAVRHAEGIWSHLSTNSKGKLPAEVEEKLTSAAAAASAAVSVAKAAAEAAKMASEAALQAKMMAEEVLSSTYANSSQKHDAGEFKVSNNLASFSSLTPTSSWKTKDDISKGSIISVAREVARKRVEEAAAAAKRAENLDAILKAAELAAEAVFKAGTIIGMGEPLPFTLSELLEAGPDGYWKSDQVRNKKATKLELPTDFSKSGRKRGGKAKHDHAIQNLEPSSSGKGLQLDVVHSGNVAEDVPTIAPVNGNRNDAAPNIIWNGIEKGSAVEVLVHKGESGVAWFSAKVLDINNDSACISYDSHTEETGLRKEWVPLRQEGEKAPQIRLAHPATVSRFKGTRKRRRDTSGNYSWAIGDHVDVLIEDSWREGIISRNRDGDETKLTVQFSGIIVM

SEQ ID NO: 445 - DNA, 5157 bp, Populus trichocarpa
atggattatgatgaaaatgattttcaaaaccacaatcttcatttagctggtgaaggaagcaacaaatttccttctgttttacagccatatgctcttcccaagtttgatttcgatgacagtcttaatggatctttaaggtttgatagtttggttgagactgaggtttttcttggcatcgaaagtaacgaggacaaccagtggattgaagatttctctcgtggtaccagtgggatacagtttagttcaagtgcagcagagtcttgttctctatcaagacgcaacaatgtctggtctgaagctacttcctcagaatctgttgaaatgttattgaaatctgttggccaggaagataatactcctatacaaactaatactaaggagtcagatgcctgtgatgaactgggttgcatactaaagcacatggagcccatcttgaaacaggataatgatacatcacctaaagtggaagatactgcgaatttacaggctacatttctgccaggcgaggatgtggaagatttttctgtgttggataatgatgttggacagcagcagcctcttgatgatagttctcaggatcataaaggtgaagcatctgctgatagtggtttgggacctttagttgacccatctgctgttagtgtagaggtcaggcaacctgttattgaagggagtctgtccattgatagtaaatctaatcatgttactcaaagggaaatcgataatgtcgtgaatggatcttcaaatgataggccacagaaagttcctgcttcagggatgcaggatggtgcctctgtgcaaaatatcactacaggaaatattgaattgaatgaaaaagatggccctgatgatataaataacacttctgatgatagtaaagattttctggaaacagacactggtgagaatcagaaaaagggacaagtattaagtcaagagggccaaatggaggatgagaatccttgttcagatgcagtggaatctatggaagaagcaaacgtcattgaaactaattcgagtaatttgggggaaccttcttgcaaaatactgaaggggcattctggtttcccagaagacgtagtgactagtgatcagtccgaagtggatacagttgggggatcagtgatggctgttgaaggtaatactacttttaagagggatgaaattgaggactcaaatggttcccaattggataacaagaacctatctaataagtgtgagggatctctcctgtctgctgaagactgtgagcctgctaaagtgaaagttggtggaactagcagcagcgatacaggtggtgtttctagtttggctacagtgtgctgttcagctgaagttgttggagaagtggcccatgtttcatcctctttccttgttgaatcatcacaaatatgtgggaagtctatggtttctgctgagggaaaggagaccacagagcttccttctggcaatgttagcactgaaaacaatttcatagcttcgagattacaatcagatgctgcttctgacaacaattcggcatcagatgttagctgcgaacatgctaacatggtaacctgtgctacaatggatggtgttccagcgccttctggtgatgtcactaatgtagatgcagttattggtcacaaagatgtcaaaatgtcacttttaagtgagatggggtttagtcccttagatatagagaaagaaaccgtggacaagatttctgtggaggccagtttatcaggtctgaagacatcttgtcaagtgatagctggattagatcctggttctgaatccaaaaaaggcgcttcttctggtgctgcaggacagatattatgcgagtcagctgaacaatctccattaatggtggatgctagtaaaacagaaggacctcattcagaagtaattgataaggtcagcctgcagagcacaaaggaaatgaatgtgtgtccagttctttgtgattcaactgcaaacaagggtgatgatgctgaagtgtttgtaaaagaaaatgatgaaaaggaatcatccaaagtttcagaaccgactgtaaacaagaatgagatgctaggacctatctcctcagaaaaggaagagtgtcgagaggatactaaccagaaaggtcaggaagaaaatgaagctgccatagtgtctgaagataatagtgatgggaatattgctgtccctagcacaaacgattgtggaagttgtgctgatgttggcaaagcagccagtggttcccctactgtcatcagagccgccagagattttcagagtgaaagtgacaaggatggagccaaatgttcagttgagcagactgctgttgctgatagcaatgccagcaaagctttgtctggttctcgggatccgaaacaaaatgatgcatccaaagatgaaaggagcttcacttttgaggtcagtccattggcaaatatgcctcaaaaagaagttggcaataaatggcagccctttttgaacaaaccagccactaaagcctacccgattttgaatgcttctccatcatcgggtttagtccaaatagatcccaagcttgcccaagatcttcctcatggaagtccaaaggtgtctgatgtagccattgtgcgtagtggttctaaaggtacttctgagcgtaaaacaagacgatcatctggtaaggccatggaaaaggaaagtgcgagaaagggaaatcctattaaagatactgcttctgtgaggctagaaaagggggcaaaaacaaacaatgtctccccaagctcttctgggatattgcaacatgtgcaatcaaatgagatgcagcgctatggtcatgcggattccagtactatgaaaccatttgttcatgcatcttcaagccttccagatctgaattcttctgcttctccatctgtgatgtttcaacaacccttcacggacttgcaacaagtgcaattgcgtgctcagatctttgtttatggcgctttgatacaaggaacagctccagatgaagcatatatgatatcagcatttggaggatctgatggtgggaaaaccatatgggagaatgctctacgctcttctatagaacggcttcatggtcaaaaacctaatctcacttctccagaaacccctttgcagtcacgtcctggtgtcagagctcctgatcaagcaattaaacagagtactgttcaaagtaaagtaatctcttcacctattggtcgatccagcaagggtactccaacaattgtgaaccccatggtacccctttcttcaccgctctggagtgtacctacccccgctggcgacacatttcaatcaagcagcatgccaaggggtcccattatggatcatcagcgggcactttctcctatgcatcctcatcaaactccacagataagaaattttgctggtaatccttggctatctcaggcacctttttgtggtccctgggctacatctccacaaacacctgcacttgacacaagtggtcatttttctgcgcaattgcctatcacagaaccagttcaattgacacctgtgaaagacttatccatgccaattatctctggtgcaaagcatgtttctcctggtcctgtagctcagagtggggcttccaccagtgtttttactgggacttttcctgttccagatgcaaaaaaggctgcagtgtcatccagtcaacctcctgctgatccaaaacctaggaaaagaaaaaagaactcggtttctgagagtccgggccagaatattttgcctcctcaccttcgaacagaatcagtttctgctcctgttgttaccagtcatctgtctacttctgttgccattacaacccctgtcatctttgtttctaaagcccctacagagaaatttgtgacttctgtatctcctacacctactgatatcagaaacgggaatcagaatgcagaacagaggaatattttgtcagaggaaacccttgataaagtgaaggctgcgagagtgcaggcagaggatgctgctactcttgctgctgctgctgttagtcacagcctggaaatgtggaatcagttagataagcagagaaattctgggttatcaccagatattgaaaccaaactagcttctgcagctgtcgcaatagcagcagctgctgctgttgcaaaagcggcagcggcagctgccaaagttgcatctagtgctgcattgcaagcaaaactgttggctgatgaagcagtaaattctggtggttacagcaatcccagtcaagacaatacaatttctgtttctgaaggcatgaagaatttgggaaaggctactcctgcttccatcctgaagggtgatgatgggacaaacagttccagttcaatccttattgtggcaagggaggctgctagacggagagttgaagttgcttccgctgctgcaaaacgagctgaaaatatggatgctattgttaaagctgcggagctggctgcagaagctgtgtcccaagctgggaagatagttgctatgggcgatcctttgccactgaatgagctagtagctgtgggtccagagggatattggaaagtagccaaaataaataatgaactgatctctaaatcaaatgatataggtagaaaaactcttaatatagatagagttggagaaagaccacgcactccaactgaggggtccactgaggaccatgttagattggaagatggtttcttgagttctggtgcagctgctgcaaaggatgttaaaggacaaaagggctacaaggtgtctgaatctgagaatggtttaagatctttgggaactatagaaaactttaatagcatcaaggaggggtcccttgtagaggttttcaaagatgggaatggatttaaagcagcctggttctctgccaatgtcgtggatttaaaggatgggagtgcatgtgtgagttatactgatctttcatcagttgaaggctcagagaagctaaaggagtgggtgacacttaaaggtgaaggagagagagcgccaaaaatacgaatagctcgccctattactgccgtgcaattagaaggaacaaggaagaggcgacgagctgccacggtggaccatatttggtctgttggtgatagagtggatgcatggatacaagatagctggtgggaaggagtggtcattgaaaggagcaagaaagatggcaccacactaacagtccaatttccaggcatgtacaattga

SEQ ID NO: 446 - protein, 1718 aa, Populus trichocarpa
MDYDENDFQNHNLHLAGEGSNKFPSVLQPYALPKFDFDDSLNGSLRFDSLVETEVFLGIESNEDNQWIEDFSRGTSGIQFSSSAAESCSLSRRNNVWSEATSSESVEMLLKSVGQEDNTPIQTNTKESDACDELGCILKHMEPILKQDNDTSPKVEDTANLQATFLPGEDVEDFSVLDNDVGQQQPLDDSSQDHKGEASADSGLGPLVDPSAVSVEVRQPVIEGSLSIDSKSNHVTQREIDNVVNGSSNDRPQKVPASGMQDGASVQNITTGNIELNEKDGPDDINNTSDDSKDFLETDTGENQKKGQVLSQEGQMEDENPCSDAVESMEEANVIETNSSNLGEPSCKILKGHSGFPEDVVTSDQSEVDTVGGSVMAVEGNTTFKRDEIEDSNGSQLDNKNLSNKCEGSLLSAEDCEPAKVKVGGTSSSDTGGVSSLATVCCSAEVVGEVAHVSSSFLVESSQICGKSMVSAEGKETTELPSGNVSTENNFIASRLQSDAASDNNSASDVSCEHANMVTCATMDGVPAPSGDVTNVDAVIGHKDVKMSLLSEMGFSPLDIEKETVDKISVEASLSGLKTSCQVIAGLDPGSESKKGASSGAAGQILCESAEQSPLMVDASKTEGPHSEVIDKVSLQSTKEMNVCPVLCDSTANKGDDAEVFVKENDEKESSKVSEPTVNKNEMLGPISSEKEECREDTNQKGQEENEAAIVSEDNSDGNIAVPSTNDCGSCADVGKAASGSPTVIRAARDFQSESDKDGAKCSVEQTAVADSNASKALSGSRDPKQNDASKDERSFTFEVSPLANMPQKEVGNKWQPFLNKPATKAYPILNASPSSGLVQIDPKLAQDLPHGSPKVSDVAIVRSGSKGTSERKTRRSSGKAMEKESARKGNPIKDTASVRLEKGAKTNNVSPSSSGILQHVQSNEMQRYGHADSSTMKPFVHASSSLPDLNSSASPSVMFQQPFTDLQQVQLRAQIFVYGALIQGTAPDEAYMISAFGGSDGGKTIWENALRSSIERLHGQKPNLTSPETPLQSRPGVRAPDQAIKQSTVQSKVISSPIGRSSKGTPTIVNPMVPLSSPLWSVPTPAGDTFQSSSMPRGPIMDHQRALSPMHPHQTPQIRNFAGNPWLSQAPFCGPWATSPQTPALDTSGHFSAQLPITEPVQLTPVKDLSMPIISGAKHVSPGPVAQSGASTSVFTGTFPVPDAKKAAVSSSQPPADPKPRKRKKNSVSESPGQNILPPHLRTESVSAPVVTSHLSTSVAITTPVIFVSKAPTEKFVTSVSPTPTDIRNGNQNAEQRNILSEETLDKVKAARVQAEDAATLAAAAVSHSLEMWNQLDKQRNSGLSPDIETKLASAAVAIAAAAAVAKAAAAAAKVASSAALQAKLLADEAVNSGGYSNPSQDNTISVSEGMKNLGKATPASILKGDDGTNSSSSILIVAREAARRRVEVASAAAKRAENMDAIVKAAELAAEAVSQAGKIVAMGDPLPLNELVAVGPEGYWKVAKINNELISKSNDIGRKTLNIDRVGERPRTPTEGSTEDHVRLEDGFLSSGAAAAKDVKGQKGYKVSESENGLRSLGTIENFNSIKEGSLVEVFKDGNGFKAAWFSANVVDLKDGSACVSYTDLSSVEGSEKLKEWVTLKGEGERAPKIRIARPITAVQLEGTRKRRRAATVDHIWSVGDRVDAWIQDSWWEGVVIERSKKDGTTLTVQFPGMYN

SEQ ID NO: 447 - DNA, 1023 bp, Glycine max
atgaatcacttattaacaatgcaacagaaaaggctgtactcaaacttcttcaactggctattgaagtgtataaaattactcatgtcagaaccaagtgaccagcttctaccatataacagtgaacttgttattgtattcctgaagtttctctatgaacaagatccagttaaacaattgctggaagtatcagaaacagaatatgaagttgaaattgatttggaaacaatgcagagagttagagaattagttcagtttgggggatttgctgacactgaatatctaaggagaacattggttaaagaatttcagctgatggaattaagctttaaagaggcttttgaaatgccttttaccacaatatcaagaaagatactttgtgaggatatactacctctgtttcctcttccatctttgccaaaatcatcttcttccatgtggattcccacttcagtatcatattatgaggatccctctagagcttctgtgccaccttactcttgtcaaaaccagtttattgattacatatctttccaagtacctgatgagtgtttctcagatattgtaaattgtatatgcatagtcagaggattcatgcatgactcagactgtctaaagaaggggtatagttctttggaagctgtactgttatgtgttcctgttgattatcaatgtgtggatctgtctttgtacaaggatagtcaaatcgtcctgttactaaacaaagctactaatacatcagaaagtgctggagatggttgtatgatgattctgcaagtaagtgatctaccatatgtctctatgtcaagatctgcttgtatagatgtttggaggttaccagaactaaaggattctgtcgcttacctgaatattggggatgagaaatctcgcaccattcgtcattctgtaattgctcccttggcagttagtgcatcaagaggcgtggcttgtgtatttgctgcaacaaagcgtgctctagtctacattttggaggaagatgaagatgaggtctcggatgtagaatag

SEQ ID NO: 448 - protein, 340 aa, Glycine max
MNHLLTMQQKRLYSNFFNWLLKCIKLLMSEPSDQLLPYNSELVIVFLKFLYEQDPVKQLLEVSETEYEVEIDLETMQRVRELVQFGGFADTEYLRRTLVKEFQLMELSFKEAFEMPFTTISRKILCEDILPLFPLPSLPKSSSSMWIPTSVSYYEDPSRASVPPYSCQNQFIDYISFQVPDECFSDIVNCICIVRGFMHDSDCLKKGYSSLEAVLLCVPVDYQCVDLSLYKDSQIVLLLNKATNTSESAGDGCMMILQVSDLPYVSMSRSACIDVWRLPELKDSVAYLNIGDEKSRTIRHSVIAPLAVSASRGVACVFAATKRALVYILEEDEDEVSDVE

SEQ ID NO: 449 - DNA, 2334 bp, Medicago truncatula
atggaaatggatgaggcatgtcgagtgcttccatttcagcttcaattcgataaaccccttgcttctcaggtgaaaatcgcggagtggaatcctgagaaggatttgcttgctatggtttctgatgactctaagatcttgcttcatcgtttcaattggcaacgcttgtggaccattactccaggaaaatgtgtaacgtccttgtgttggcgtcctgatggtaaggcaattgctgttgggcttgatgatggaacgctgtcactatatgatgttgaaaacgggaagttgttaagaagcttaaaatcacactgtgctgccatcatatgtctcaattgggaggaggacagccacctaattactgatgaccattaccacacctcaaagtatgaagatagaacctcccgtttctttcctcctgctccaaaaattcctcgaatgcctggattggtatctggggataatggcttcatggatgatggtgacgattcatttgaggaactgtcaaattcttctcaccaacgatttaacgtcttatgtagcggagacaaagatgggaatatatgttttagtatatttggcatcttccctatagggaaaactaacatacacaacctcacttttcctacttctagtgatggcgctaaaagcagcaaaagacttttgaatgcttgtatacacaaggttgctttatcaaaagatctttgtcgtttgatagtcatgtgctcaggagaccttgttgaagttgttgatgacctgggcgttattcacatggctgggcataatgcaaatggcttgcattgcttagccctgaacacagctatattttggaataggaaaaacgagctccatcaggtagctcagcaagcttctaacatcgaggatttgactgaggttgttcgggcatcattatcagtcatgtctaggcagtggtctgatgccatgcatacattcaaggaaaagttcaactctttgtctactctgattacggatcacggacttgattcctctccccaagaggagtttctgggccttttgggtggtgcaaggaccagtccaccagttcatcaatttcttgttagcactcttggtgaagtgggtgttaagcgcatttcgaaggttctatgcggtgctggcaaagaacttcaacgtattgtcttggagcacctccagcctgctgtagaagttattgggttcagaatgggagaattaagagggctttcaagatggcgtgcacgatatcacggcattggcttggatgaaccactcattagcaatgcaacagaaaaggctggtatgctacttgtacaagttgaaagatttatgagggttctttcatctgtcttgcagcagtattcaaatttcttcaactggctattaaagtgtatcaaattactcatgtcagaaccaagcgaccagcttttaccatataacagtgaacttgttattatatttctgaagtttctgtatgaacaagatcctgttaagcaactgctagaaatatcagaaacagattatgatgttgaaattgatttggagacagcggaaagaattaaagaattagttcagttcgggggattttctgacactgaatatctccggagaactttggctaaagaatttcaacagttggagttgagctttaaagaggcctttcaaatgccttttacgacaatctctagaaagatactttgcgaggatttattaccgctgtttccccttccatctttgccaaatgcgtcatcaatgacgagaattagtacctcaatatcatattatgaggattcctccagagcttcttcctcacattacaccggtcaacatcaagttattgattacatatcttttcaagtacctgacgagtctttctcagatattgaaaaatgcatatgcatagtcagaggatttatgcatgacgcagactctctaaagaaggggtacagttctttggaagctgtgctattacgtgttcctgttgattatcaatgtatcgatctgtcattgtacaaggatagtcaaattgttttgctactaaacaaagctactaatacttcagaaagtgctggagatggctgcatgataattctgcaagcaagtgatctcccatatgtctctatatcaagatctgcatatatagatgtctggaggttacaagaactgaaggattctgctgcttgcctgcatataggggatgagaaaactcgtaccatcccacattgtgtaattgctcctttggcagttagtgcttcaagaggcgtggcctgtgtatttgctgctagaaagcgtgccctggtctatattttggaggaagatgaagacgaggtatcggatgcagaatga

SEQ ID NO: 450 - protein, 777 aa, Medicago truncatula
MEMDEACRVLPFQLQFDKPLASQVKIAEWNPEKDLLAMVSDDSKILLHRFNWQRLWTITPGKCVTSLCWRPDGKAIAVGLDDGTLSLYDVENGKLLRSLKSHCAAIICLNWEEDSHLITDDHYHTSKYEDRTSRFFPPAPKIPRMPGLVSGDNGFMDDGDDSFEELSNSSHQRFNVLCSGDKDGNICFSIFGIFPIGKTNIHNLTFPTSSDGAKSSKRLLNACIHKVALSKDLCRLIVMCSGDLVEVVDDLGVIHMAGHNANGLHCLALNTAIFWNRKNELHQVAQQASNIEDLTEVVRASLSVMSRQWSDAMHTFKEKFNSLSTLITDHGLDSSPQEEFLGLLGGARTSPPVHQFLVSTLGEVGVKRISKVLCGAGKELQRIVLEHLQPAVEVIGFRMGELRGLSRWRARYHGIGLDEPLISNATEKAGMLLVQVERFMRVLSSVLQQYSNFFNWLLKCIKLLMSEPSDQLLPYNSELVIIFLKFLYEQDPVKQLLEISETDYDVEIDLETAERIKELVQFGGFSDTEYLRRTLAKEFQQLELSFKEAFQMPFTTISRKILCEDLLPLFPLPSLPNASSMTRISTSISYYEDSSRASSSHYTGQHQVIDYISFQVPDESFSDIEKCICIVRGFMHDADSLKKGYSSLEAVLLRVPVDYQCIDLSLYKDSQIVLLLNKATNTSESAGDGCMIILQASDLPYVSISRSAYIDVWRLQELKDSAACLHIGDEKTRTIPHCVIAPLAVSASRGVACVFAARKRALVYILEEDEDEVSDAE

SEQ ID NO: 451 - DNA, 2355 bp, Oryza sativa
atggcagagtggaatccagagaaggatctacttgctatggttactgatgactctaaggttgtccttcatcgattcaattggcaaaggctatggactatctccccagggaagtgcatcacatctatttgttggagccccgatggtaaaatagtagcacttggtaccgaagatggtttggttcttttgcatgatgttgagaatgggaaaatgctaagaagaataaaatcccatgatgttgccattgtatgtttgaactgggcagaagatgagcttctatcaaggaccgacaaggatggcctgttatcctatgaagaccgcactgcacgcttctttcctcccgctcctgtgattcctaggatcggtgggctgagttctggagacactggtctttcagatgagaatgaagaatccattcaggaattttcaagcgcttcctgccagcgttttaatattctgtgcagtggtgataaaggtggttgcatttgcttcagtatctttggaatattcccagttggaaagataaacattaatgaggttcctatccatttccaatcctctggaaacaaaactagttaccggcttcaggatgcttccataagcaaggtctgtttatcaggaaacctccatcagttagttctcctgtgccctggaaagctgattgatattgacaacctttctcatagtaatcacatttctactgggttacattgtctgcatttggacacttctatctttttcaacaggaaaaatgagctacatcagatctcccaacaagcatcaagtattcaagatctggttgaagttgtccgttcttccctatccatgatggccaaacaatggtcaagtgccatgaacttatttaatgaaaaattcagcgccttgccttctctgatagctgcccatgggatggaatctagctctgaggatgagtttatgagccttttgtttggtacacgtacaagtccagcacttcaccaatttttagtcagctcacttggtgaagcggctctcaagagaatagctaaggctgttgatagtgctggacgagaacttcgtgttgttgtcagtgagcatcttcagcctgcagttgaaattatttcattcagacttgcggaactaagaggccttgcaagatggcgctcacgatttcagaacgttgggttagatgaaaagcttatttatggtgtgactgagaagataggaatgctagttgttcaagttgagcgtttttcaagggttgcggctactgttctttatctggtaccattcttctctgcttgttttcttgccatgttctcaattctcaacctctgttttaacttaggccttctgcccgagattcccctccctgtatcagaatatgacatcttggtgcatgtagtatctgctgagttccaaaatttcttcagttgggttttaaagtgtgttaagattttattaagtgaaccaaccgatcaagttccagctgcgaacagtgaactcgtggtgctttttctgaagttccttcttgataaggatccaatcaaacagttacttgatgcaaatcaaagatttgagtgtgatttggacactgtaagacatcttgagcagctagtagttttggggggatttacagatacccattttttggaaaagactttaatgaagcaatttaatgagctggatgaaagcctggaggaggctttctcgatgccattcaccactatttcttcacaaatacattgccaagaattgcttcctctttatcctatcacgtcatcggttgacttgtcatcaacctgtattctgacatcagtgtcattctataaggatgaagattctcagaatagtgggtcttcatatagcttgactgactatatatgcttcaagatacccgatggatccttgaacttgaagaattgcattggtgtgataaaggacttctctaactcttctgccagcggaccatcttcttcaggatttctattgcatatacctgatgaatatgagtgcgttgatgtatctctttacaaggacagccagattgttgtactactcagtgaaaggtcatattctgatggtcctggaagttcttatattgtaatgctgcagatggagaacttctcttttgtgcctctctcaaggatgttcccttcaaatatttacagtgtacaagagctgtcggcacaggagctccagttggacaccgactatgggaaaaaagttcgtagcatacctcacgccgtgtccactccactggcagtcagtgcctcaagaggagtggcttgtgtcttttcatctcggcggcatgctttggtttatatccttgatgaagatgaggatgaggatgaggatgaatcttctgatatggaatga

SEQ ID NO: 452 - protein, 784 aa, Oryza sativa
MAEWNPEKDLLAMVTDDSKVVLHRFNWQRLWTISPGKCITSICWSPDGKIVALGTEDGLVLLHDVENGKMLRRIKSHDVAIVCLNWAEDELLSRTDKDGLLSYEDRTARFFPPAPVIPRIGGLSSGDTGLSDENEESIQEFSSASCQRFNILCSGDKGGCICFSIFGIFPVGKININEVPIHFQSSGNKTSYRLQDASISKVCLSGNLHQLVLLCPGKLIDIDNLSHSNHISTGLHCLHLDTSIFFNRKNELHQISQQASSIQDLVEVVRSSLSMMAKQWSSAMNLFNEKFSALPSLIAAHGMESSSEDEFMSLLFGTRTSPALHQFLVSSLGEAALKRIAKAVDSAGRELRVVVSEHLQPAVEIISFRLAELRGLARWRSRFQNVGLDEKLIYGVTEKIGMLVVQVERFSRVAATVLYLVPFFSACFLAMFSILNLCFNLGLLPEIPLPVSEYDILVHVVSAEFQNFFSWVLKCVKILLSEPTDQVPAANSELVVLFLKFLLDKDPIKQLLDANQRFECDLDTVRHLEQLVVLGGFTDTHFLEKTLMKQFNELDESLEEAFSMPFTTISSQIHCQELLPLYPITSSVDLSSTCILTSVSFYKDEDSQNSGSSYSLTDYICFKIPDGSLNLKNCIGVIKDFSNSSASGPSSSGFLLHIPDEYECVDVSLYKDSQIVVLLSERSYSDGPGSSYIVMLQMENFSFVPLSRMFPSNIYSVQELSAQELQLDTDYGKKVRSIPHAVSTPLAVSASRGVACVFSSRRHALVYILDEDEDEDEDESSDME

SEQ ID NO: 453 - DNA, 2466 bp, Physcomitrella patens
atggttggggaagagagtgggagtgggagagcggggcagtgccgcggcgctgttctggtggcagcgatggcggaccttgctcaggatgtcgacgatgaagccggtgaggagacgctggtcttcaccttgcacctcgacaagcctctcagctcgcagttgcatgagagtcttggagtttttcgagctgcaattactcttgttggttgtttcgtgggagtcgctgggcattcgttcgaggtggagaaggcagcatggaatccagacaaggatttgctcgccatggtcactcgagaccatcaaatcattgtgcaccgattaaactggcagcgactttgggcgatttctccagaaatgacagttacttcactttgctggcgtcccgatggaaaggctttggcagtcggacacgatgatggcagcatcgcaattcatgacgttgagaatggtgatgtattgcgacagcaaacaacacacgatgcgccggtcgaatgcttgtattgggctatggagggacatcaatcagtgggtcacgaagatgatgtcttctgctacgaagatcgaaccccaagattctttccgtcacctccacatgctcctcctttgcctggaacggtctcatctttcgatatgtctggagtattaggtcatgctgctgaagaccaaacctatgctaatcggaagaatgtgcttcgagctattcatgaacgactttatattctctgcagtggagatcgaaatggcaccatttgcttaagtgcatttggtgtttttcctattggaaagttggacatcagggacctatctataaatggaatgacatctgactacaacatcgtggcaaagccaatataccgacttctggatgcctcagttcaacaggtcgctttgtcaaaagacctccgcaacatgacagtgatttgtagtggagtccaatcggtggcgagcttgcatgttatggcaggtgctgagtctagggcaactggactatatgccatttctattgacacttcccttctaggagataggagaaaggaactgcgtcaagtggcgcttcaggcttccaaggtggaagagttgttagaagttgttgaggccaccgtgatggtgatgcgcaagcattggagcgatgctatttcttcatttgaaaacaaatttcgaactttttctaccttgcttacagagcatggttcacatgtgaagcctcgtgatgaatttttaagtcttcttgcctgtggctccgcaagtgcggcgttgcaccaatttcttgctgcttctttgggagaagcaccagcagctgagctcatttctttcataattggtgaactgcgaggtctctcccgatggaggtcgcgtctgcgtagaattggacttcatgaaactctccttgaacaagccatggagaatgctggcatgctccttattcaagttgagcgccttttgcgcattgtctctgacacgaatggccagtttcggctctttttcgtttggctcacaaagtcgttgcgtcaattaaatggtgatactggaccacaagctagccagcttccggccattgacagtgcaggggttgcagactttttacgtactcactttgagaaggatccaatcggcccacaccttgcacccgcctcggatgaacttactatggacgtcaacgtcgaggagcaggctaggatggaggaactagcgataatgggaggatttgcagatactaagtttttaaccagaactttatcctcccaagttcatcggcttcgagctagctgtcaggaggcatttcaaatgccagtcaaagaagtgtctcctaatcttcgaccccggtgcatgttgttgttgttgtctcctttgccgtcattaccaccaccttcgaccgtaccactttctctcacctacttcgagaccgattcaggaagcaaaatgaaggacatcctccttgaagactacatttgtttacgagtgcaggatgatacaaattcaactgatcagagttctgtgataatattgcgaagcttcgcagtgtcggggcactgcgcaccaggaggaaaaggtttagaagtgtttgcgttgcaattggagaagactctgcactgtattgacttggctctttacaagcaaaagcaagttatactgttagtaagcgagaaggatccggaggacactgggaagatcgttcaaacatacttaatgatgctccaactggaggaccttgaatttgtggcgttgtcctctaccagtacccacatgagtcgtgtgtccttgttgcatttgtgctccaatcttggagcagttacggttgttggtttaaacagtggtaaagtaagggctattcaacaggttgatgcagttcctcccttggctgttagtgcttctcggggtctggcatgtgtctttgctgggcaacggcgtgcgctgctttacgacctggaggaggacgaagaggacaaagacgacgatgatatggagtga

SEQ ID NO: 454 - protein, 821 aa, Physcomitrella patens
MVGEESGSGRAGQCRGAVLVAAMADLAQDVDDEAGEETLVFTLHLDKPLSSQLHESLGVFRAAITLVGCFVGVAGHSFEVEKAAWNPDKDLLAMVTRDHQIIVHRLNWQRLWAISPEMTVTSLCWRPDGKALAVGHDDGSIAIHDVENGDVLRQQTTHDAPVECLYWAMEGHQSVGHEDDVFCYEDRTPRFFPSPPHAPPLPGTVSSFDMSGVLGHAAEDQTYANRKNVLRAIHERLYILCSGDRNGTICLSAFGVFPIGKLDIRDLSINGMTSDYNIVAKPIYRLLDASVQQVALSKDLRNMTVICSGVQSVASLHVMAGAESRATGLYAISIDTSLLGDRRKELRQVALQASKVEELLEVVEATVMVMRKHWSDAISSFENKFRTFSTLLTEHGSHVKPRDEFLSLLACGSASAALHQFLAASLGEAPAAELISFIIGELRGLSRWRSRLRRIGLHETLLEQAMENAGMLLIQVERLLRIVSDTNGQFRLFFVWLTKSLRQLNGDTGPQASQLPAIDSAGVADFLRTHFEKDPIGPHLAPASDELTMDVNVEEQARMEELAIMGGFADTKFLTRTLSSQVHRLRASCQEAFQMPVKEVSPNLRPRCMLLLLSPLPSLPPPSTVPLSLTYFETDSGSKMKDILLEDYICLRVQDDTNSTDQSSVIILRSFAVSGHCAPGGKGLEVFALQLEKTLHCIDLALYKQKQVILLVSEKDPEDTGKIVQTYLMMLQLEDLEFVALSSTSTHMSRVSLLHLCSNLGAVTVVGLNSGKVRAIQQVDAVPPLAVSASRGLACVFAGQRRALLYDLEEDEEDKDDDDME

SEQ ID NO: 455 - DNA, 2181 bp, Populus trichocarpa
atggaaaccgacgagaccgatcgcgtgcttcctttccaacttcaattcgataaaccggtcgcttctcaggttaaaatcgcagagtggaatcctgaaaaggatttactcgcaatggtaactgaagactccaagattttactccatcgattcaattggcagaggttatggactatctcccctggaaggaacattacatcattgtgttggcgaccggatggtaaagcgattgccgttggtcttgaagatggaaccatttatttacatgatgttgagaatggcaaattgttgagaagcttgaagtctcataccgttgcagttgtgtgtcttaattgggaggaggaaggacaacttattagagatgactctaaaaactcctcatcatatgaagaccgcacttcccgtttctttcctcctgctcctagggtcccccggatgcctggagtagtgtctggagatactggcttcatggatgacagtgaagattcatatagagagctgtcaaactcttcgtaccaacgctttaatattctgtgtagcggagataaagatggaagtatatgctttagcatatttggtatatttccaatcggaaaaattgtttctctgtcgaaagacctctgtcgtttgattgtcatgtgctcaggagaacttaatgaaaacacagaatcaagagaaagccaaatggtcaagcagggtatgcatagcttagtgctcgatacttctatattttggaagaggaaaagtgagctccatcaattggctcaacaagcttccaatattgaggacttaactgaagttatcagggcgtctttatcagttatgtgcaagcagtggtcagatgccatgcacacatttcatgagaaatttgattctctgtctaccctgattattgaccatgcactggactctactccacaagaggaatttctcagccttttagggggtgctcggaccagttcagcagtacatcaatttctagttaactcccttggtgaagtgggtgtgaagcgcgtgttaaaggtcatttgtgggacagcaaaagaacttcagcgcattgtccttgatcatttacagcctgctgcagaaattattggatttagaatgggagagctaagaggcctttccagatggcgtgcacgctaccatggtattggtttggatgagatgcttattaacaatgcaacagaaaaatctggtatgatactagtgcagattgaacggtttatgagggtcctttcatctgtggagcagcagttttcaaatttcttcaattggcttcttaaatgtataaagctgcttatgcaagaacccagtgaccagcttcttccatacaatagtgaacttgttgtcatattcttgaagttcttatacgatcaggatccagttaagcagttgctggaagttgatcatgatattgaagttgacttagaaacaatgcagagagttaaggaattagttcagtttgggggattttcagattgtgaatatctgcaaagaacattggctaaagaattccagcaaatggaggacagcttcaaggaagctttcctgatgccctttactaccatatcaagaaagatgctatgtgaggatttgctgccactgtttcctcttccatcttcatcttcatcagcatctgtatctatggcaattcccatgtcaatatcatactatgaggatgcttctcaagctgtttcatctaatcagacatgtcaacacagttttgttgactatgtatgcttccaagtacctgatgagccattttcagatattgcaaactgtataggcgtaataagaggatttacgcatgacttgagcagttcaaagaatggttatacttcattggaagctgtactgttgtatgttcctgctggttacgagtgtgtggatctctcattatataaggatagtcaaattgtcttgttgttaaatggggcatctgcgtcatctgaaagttctggagatgcttgtatgatgattgtgcaagctagcgagcttccatttatatctatttcaagattcaccgacttaaacttatggaacttgtatcaactgaaggattctactgtgcaactgcaaatggagaacgaaaaagttcgcaatattcctcactctgtaattgctcccttggcagttagtggtaagtgtccctcctctcagctccattccattggtttttaa

SEQ ID NO: 456 - protein, 726 aa, Populus trichocarpa
METDETDRVLPFQLQFDKPVASQVKIAEWNPEKDLLAMVTEDSKILLHRFNWQRLWTISPGRNITSLCWRPDGKAIAVGLEDGTIYLHDVENGKLLRSLKSHTVAVVCLNWEEEGQLIRDDSKNSSSYEDRTSRFFPPAPRVPRMPGVVSGDTGFMDDSEDSYRELSNSSYQRFNILCSGDKDGSICFSIFGIFPIGKIVSLSKDLCRLIVMCSGELNENTESRESQMVKQGMHSLVLDTSIFWKRKSELHQLAQQASNIEDLTEVIRASLSVMCKQWSDAMHTFHEKFDSLSTLIIDHALDSTPQEEFLSLLGGARTSSAVHQFLVNSLGEVGVKRVLKVICGTAKELQRIVLDHLQPAAEIIGFRMGELRGLSRWRARYHGIGLDEMLINNATEKSGMILVQIERFMRVLSSVEQQFSNFFNWLLKCIKLLMQEPSDQLLPYNSELVVIFLKFLYDQDPVKQLLEVDHDIEVDLETMQRVKELVQFGGFSDCEYLQRTLAKEFQQMEDSFKEAFLMPFTTISRKMLCEDLLPLFPLPSSSSSASVSMAIPMSISYYEDASQAVSSNQTCQHSFVDYVCFQVPDEPFSDIANCIGVIRGFTHDLSSSKNGYTSLEAVLLYVPAGYECVDLSLYKDSQIVLLLNGASASSESSGDACMMIVQASELPFISISRFTDLNLWNLYQLKDSTVQLQMENEKVRNIPHSVIAPLAVSGKCPSSQLHSIGF

SEQ ID NO: 457 - DNA, 795 bp, Zea mays
atggatactgcaagacatgtagaacagctagtagtttttggaggatttacagacacccaatttttggaaaagagtttggtaaatcaattcaatgaattggaagatagcttgaaggaggctttcttgatgccatttactgctatctcttcgcagatacaatgtcaaggattgcttcctttatatcctgttacatcatcagctaccttgtcatcatcctgctcgccaacatcaatatcattttataaggatgaagattcatcgcatgaggaatcctcctatagcttgactgactatgtatgcttgaagatacctgatggatcattaaataaagtaaattgcatcggtgtgataaagggctctggtaactgttgtactaccctcagcatgatgtcactttcaggttttctgttgcatatacctgacggatatgagtgtgttgacctgtcactttataaggacaaccaggtagttttactactgagtgaaacgtcttgttctgatagccctggaaaatcttggatggtgatgctgcaaatagagaacttttcctttatgccactctcaggaacattccctgcaaatatttacagtttgcaaaaactggtggcactcgatctgcaattggacacagattatgggaaagttcgtagcatacctcacaccgtatctactccatttgcagttagtgcatcgagaggagtagcctgtgtcttttcatcccggaggcatgccttggtttatatccttgatgaggatgaggaagcggagggggatgaaacttccgatatggagtga

SEQ ID NO: 458 - protein, 264 aa, Zea mays
MDTARHVEQLVVFGGFTDTQFLEKSLVNQFNELEDSLKEAFLMPFTAISSQIQCQGLLPLYPVTSSATLSSSCSPTSISFYKDEDSSHEESSYSLTDYVCLKIPDGSLNKVNCIGVIKGSGNCCTTLSMMSLSGFLLHIPDGYECVDLSLYKDNQVVLLLSETSCSDSPGKSWMVMLQIENFSFMPLSGTFPANIYSLQKLVALDLQLDTDYGKVRSIPHTVSTPFAVSASRGVACVFSSRRHALVYILDEDEEAEGDETSDME

SEQ ID NO: 459 - DNA, 1206 bp, Brassica napus
atggataaatatatgggactaagtgacgattctcctcctcgaacaagcacgcttgttctgtctgagttcattggttgctctccttctttaagtggcgccattagggttaacccttgggacgttgatgcggtggctgattcaatgtactctgctctcaccatgcctgattctgagaagcagctacgccataagaagcactatcaatacataagtacacacgatgtggcgtactggtcgcacagctttgcacaggatttggagagggcgtgtcgggatcattacagtaaaaggtgctggggtgtgggttggggtttaggttttaggctcatcgctctctctcctaattacagaaggctatccgttgagcaaactgtcagtgcttatagaagatcgagcaagagagcaatatttcttgattatgacggtactttagttccggaggcctcaattgtaaaggaaccaagtgctgatgtgatctctgcgctgaagacactgtgtagtgatcctgataacactgtatttgttgttagcgggagagggaaagtttctttaagcgagtggcttgcgccgtgtgagaatcttggaatagcggctgaacatggttacttcacaaggtggaatgagtcttgtgactgggaaacaagcggcttttctaatgactttgaatggaagaaaatagtggaacctatcatgagactgtatacagaaactacagatggatctacgatagaagcaaaagaaagtgctctagtgtggcatcaccaggatgctgaccgggactttggttcttgtcaagccaaggaacttctggaccatctagaatctgttcttgtaaatgagcccgttgtggttaacagaggtcaccaaatcgttgaagttaagcctcagggagtaagcaaaggtcttgtcaccgggaaagttcttaggagaatgcttgaagaagggaatgcaccggattttgtggtatgcattggggacgacagatcagacgaagacatgtttgagagcatagcaacaactctctcggctcagccatcgtcagagatattcgcgtgtacggtgggaagaaaaccaagcaaagccaagtactttctggatgaagtaagcgacgtggtgaagctgcttcaaggacttgccaacacttcttctagcccaaagcctaggtacccttctcaccttagagtctccttcgaaagcgtggtatga

SEQ ID NO: 460 - protein, 401 aa, Brassica napus
MDKYMGLSDDSPPRTSTLVLSEFIGCSPSLSGAIRVNPWDVDAVADSMYSALTMPDSEKQLRHKKHYQYISTHDVAYWSHSFAQDLERACRDHYSKRCWGVGWGLGFRLIALSPNYRRLSVEQTVSAYRRSSKRAIFLDYDGTLVPEASIVKEPSADVISALKTLCSDPDNTVFVVSGRGKVSLSEWLAPCENLGIAAEHGYFTRWNESCDWETSGFSNDFEWKKIVEPIMRLYTETTDGSTIEAKESALVWHHQDADRDFGSCQAKELLDHLESVLVNEPVVVNRGHQIVEVKPQGVSKGLVTGKVLRRMLEEGNAPDFVVCIGDDRSDEDMFESIATTLSAQPSSEIFACTVGRKPSKAKYFLDEVSDVVKLLQGLANTSSSPKPRYPSHLRVSFESVV

SEQ ID NO: 461 - DNA, 2724 bp, Glycine max
atgcctgggaacaagtgcaatggtaattctaatagttttccggttccggatcgtcatgaacgacttatgagaggaagagagctaagaaaaagcagcagggcatctcctgatagtaatagtattagtaatgtgggtagtgaaatttttgagcatgacctgcgcttaagagaagataataactctgctgctcccattgttgaacgatacctggaagaagtggcagcagctgcagcagcagcgcggggagaaaggaaagatgggagacctttcagacaacggcttttggtggtggccaacaggctgccagtctcagcaattaggaaaggcgaggattcgtggtctttggagataagtgctggtggcctggtcagcgctctcttaggtgtgaaggagtttgaggcgagatggataggttgggctggtgtcaatgtgcccgatgagattggacaaaaggcacttacaaaagctttggctgaaaagaggtgtatcccagtatttcttgatgaagagattgtgcatcaatattacaatggctattgcaataacattctgtggcccctttttcattaccttggacttccacaagaagaccgccttgctaccacacggagtttccaatctcagtttgaagcttatcagaaagcaaatcaaatgtttgctgatgttgtaaataagcactatgaagagggtgatgttgtttggtgccatgattaccatcttatgtttcttccacaatgcttaaagaattataaccacaaaatgaaagttggctggtttctgcataccccatttccatcttctgaaattcacaggacattgccatctcgctcagaactcttgcatgctgttcttgcagctgatttggttggttttcacacatacgattatgcacggcattttgtcagtgcatgtacacgcattcttggacttgagggcacacctgaaggggttgagaatcaggggaagctgactcgagttgcagcatttccaataggtatagactcagaacgattcatacgtgcacttgaccttcctcaagtcaaggatcacatcaaaaaattacaagagagatttaatggaagaaaggtaatgttaggtgttgatcgccttgatatgattaaaggaatccctcaaaaaattctagcatttgaaaaatttttggaagaaaatcctggttggcatgataaagttgttctgcttcaaattgccgtgccgacaagaacagatgttcctgagtatcaaaagcttactagccaggtccatgaaattgttggtcgcatcaatggcagatttggaacactgactgctgttcccatacatcacctggatcgctctcttgattttcatgcactgtgtgctttgtatgctattaccgatgtagcacttgtcacatctttgagggatggaatgaatcttgtaagttacgaatttgtggcctgtcaagataaaaagaaaggggttctcattctcagtgaatttgctggtgctgcacagtcacttggtgctggggctattcttgttaacccttggaacatcacagaagttgctactgcaatttccaaggctctgaatatgccatcggcagaacgcgagaagagacataagcataactatgaacatgtaaaaactcacactgctcaggaatgggcagaaacttttgtaagtgaactaaatgatactgttgtcgaggcacagataaggacaaatcaagttccaccacggctcccaacagagactgcagttgaatgttatttgcagtcaaataatcggttgcttattttgggtttcaatggaaccttaactgagccaattgagagagaaggtgatcggtttaaagaaagggaactcacagtgcatccagaactgaaacagcccttggccgaactttgcagtgacccaaagaccacagttgttgtgcttagtggaagttgtagaacagttctagatgaaaactttaaagaatatgacatctggctggcagcagagaatgggatgtttctaaacccttcaaagggagaatggatgacaacaatgcctgagcaactgaatatggaatgggttgacagtgtgaagcatgtttttgattacttcacggacagaacacctcgatcgtattttgaagaaagggaagcttcacttgtttggagttacagacatgcagatgttgagttcggaagactgcaagcaagggacatgctgcagcatctctggacaggtccaatttctaatgcatctgttgaagttgttcaagggagccgatctgttgaggtgcgagctgctaatgttacaaagggagcagctattgaccgcattctaggtgagatagtccacagtaaatccatgacaacaccaattgattacgttctgtgtataggacattttctgacaaagcaggatgaagatatatacgcgttttttgagccagagctaccacgaagcaaggtaacagaaggagtcaagtttcctgttgagagggtatcgtcatcccaaaataagggacaacggcctgtgtcaaactctgagaagaaaacaaataatcatgtctgccgcctgccacggcggccggctcctgaaaagatctcttggaatgtgcttgacctcaagaaggagaattacttctcgtgcgctgttggacgaacacagaccaatgctcggtatacgcttgcttcaccagatgaagttgttgcatttctcaaggaactccatactttgtctcagagctaa

SEQ ID NO: 462 - protein, 907 aa, Glycine max
MPGNKCNGNSNSFPVPDRHERLMRGRELRKSSRASPDSNSISNVGSEIFEHDLRLREDNNSAAPIVERYLEEVAAAAAAARGERKDGRPFRQRLLVVANRLPVSAIRKGEDSWSLEISAGGLVSALLGVKEFEARWIGWAGVNVPDEIGQKALTKALAEKRCIPVFLDEEIVHQYYNGYCNNILWPLFHYLGLPQEDRLATTRSFQSQFEAYQKANQMFADVVNKHYEEGDVVWCHDYHLMFLPQCLKNYNHKMKVGWFLHTPFPSSEIHRTLPSRSELLHAVLAADLVGFHTYDYARHFVSACTRILGLEGTPEGVENQGKLTRVAAFPIGIDSERFIRALDLPQVKDHIKKLQERFNGRKVMLGVDRLDMIKGIPQKILAFEKFLEENPGWHDKVVLLQIAVPTRTDVPEYQKLTSQVHEIVGRINGRFGTLTAVPIHHLDRSLDFHALCALYAITDVALVTSLRDGMNLVSYEFVACQDKKKGVLILSEFAGAAQSLGAGAILVNPWNITEVATAISKALNMPSAEREKRHKHNYEHVKTHTAQEWAETFVSELNDTVVEAQIRTNQVPPRLPTETAVECYLQSNNRLLILGFNGTLTEPIEREGDRFKERELTVHPELKQPLAELCSDPKTTVVVLSGSCRTVLDENFKEYDIWLAAENGMFLNPSKGEWMTTMPEQLNMEWVDSVKHVFDYFTDRTPRSYFEEREASLVWSYRHADVEFGRLQARDMLQHLWTGPISNASVEVVQGSRSVEVRAANVTKGAAIDRILGEIVHSKSMTTPIDYVLCIGHFLTKQDEDIYAFFEPELPRSKVTEGVKFPVERVSSSQNKGQRPVSNSEKKTNNHVCRLPRRPAPEKISWNVLDLKKENYFSCAVGRTQTNARYTLASPDEVVAFLKELHTLSQS

SEQ ID NO: 463 - DNA, 2586 bp, Gossypium hirsutum
atggcatcaagatcatgtgcaaattttttacacttagcctctgggaatctacttgatattcctcaaactccgagaggtcttcctcgggtaatgactgttcctgggattatctctgacatggactcttgtagcagtaatgatggggattcagatgttgcttcatctgggtgtagagaacgcaaaattatagtggcaaatatgttacctttgcatgctaaaagagatcgtgaaacttcgaaatggcgcttcagctgggatgaggattcacttttactacatctaaaggatgggttttctcctgaaatggaggttgtatacgtaggatctctcaaggttgatatagatgtgaatgaacaggaagaagttgcccaaaagctgttagaagatttcaattgcgtccctacatttgtacctcatgatttgcagaagaagttttatcttggcttctgcaaacagcatttgtggcctctttttcactacatgctgcccatgtgtcctgaccatggtgatcggtttgaccgcattttatggcaggcatatgtttctgctaataaaatatttgctgacaaggttatggaagtaatcaatccagatgatgattatgtctggattcatgattatcatttgatggttcttcccacatttttgaggaagcacctgaatagaatcaagcttggttttttcctccacagcccgttcccttcatcagaaatatatcgaacattgcctgttcgggatgaaattctgaggggactactgaattgcgatctaattggttttcatacgttcgattatgcacgacatttcttgtcttgctgcagtagaatgctgggtcttgattatgaatctaaaagagggcatattggtcttgattactttggtcgcacggtttttattaagattctacctgtaggagttcatatgggtagacttgaatcagtcttgaatctttcctctactgctgccagggtcaaagagattcagaaacagtttgaagggaaaaaattgattcttggcatagatgatatggatattttcaaaggcatcagtcttaaattactggctgtggaacagctcttacagcagcacccagacctgcagggtaaaatagtcctggttcagattgtgaatcctgcaaggggctttggaaaggatgtccaggaggctaagaaggagacttatatgactgctaaaaagatcaatgaggtttatggttcccccaattatcagccagtgattttgattgatcgccctgttccccgttatgagaaatcggcctattatgcgctagcagaatgttgcatagtaaatgctgtgagggatgggatgaacctggttccttacaagtatattgtttgtcggcagggaactcctggcatggatgaggcactgggtgtaaagccagaatatccacgaacaagcatgcttgttgtttctgagttcatcggttgctcaccgtctttaagtggagcaattagggtaaatccatgggatatcgatgctgtggctgaggctttaaatacagctattaccatgcccgagtcagagaagcaattgcgacatgagaaacactaccggtatgtcagtactcatgatgtggcatattgggctcgcagctttgtgatggacttggatagagcatgccaggatcactatagtaaacgttgctggggcattggtttgggcctcagtttcagagttgtgtctctttcacctagttttaggaggctagctatcgatcacatttgttcggcatatagacgaacaaatagaagagcaatattcctggactatgatggcactcttgttcctgaagcttccattatcaaaactcctagccctgaggttatctctatcattaagaccctctgtgatgatcctaagaacacagtgtttattgttagtgggagaggaagagcttcgcttagtgattggcttgctccatgtgagaagctggggatagccgctgaacacgggtacttcataagatggagtaaagactctgaatgggaaaccagccctgttggtgctgaccttgaatggaaaaagattgttgaacctgttatgagcttgtatagagaggcaactgatggctccagcatagagaccaaggagagtggtttggtgtggcaccatctagatgcagaccctgacttcggatcatgccaagccaaggaattgttggatcatttggaaagtgttctcgcaaatgaaccagcggttgtccatagaggccagcatattgttgaagttaagccgcagggagtaagcaaagggctggtagcagagaaagttttgtcgagaatggtcaatggtgggaagccacctgatttcgtgatgtgtgttggtgatgataaatccgatgaagatatgtttcagagcatattaacttcagtttctaatccatccttgcctgtggctccggaaatctttgcatgcacagtggggcgaaagcctagcaaagctaggtattacctcgatgacactgcagatgttttaaagttacttaaaggccttgcaactgctacaatttcaaagcctaggtgcctgcctgagattaaggtatctttcgagagtaatgcttga

SEQ ID NO: 464 - protein, 861 aa, Gossypium hirsutum
MASRSCANFLHLASGNLLDIPQTPRGLPRVMTVPGIISDMDSCSSNDGDSDVASSGCRERKIIVANMLPLHAKRDRETSKWRFSWDEDSLLLHLKDGFSPEMEVVYVGSLKVDIDVNEQEEVAQKLLEDFNCVPTFVPHDLQKKFYLGFCKQHLWPLFHYMLPMCPDHGDRFDRILWQAYVSANKIFADKVMEVINPDDDYVWIHDYHLMVLPTFLRKHLNRIKLGFFLHSPFPSSEIYRTLPVRDEILRGLLNCDLIGFHTFDYARHFLSCCSRMLGLDYESKRGHIGLDYFGRTVFIKILPVGVHMGRLESVLNLSSTAARVKEIQKQFEGKKLILGIDDMDIFKGISLKLLAVEQLLQQHPDLQGKIVLVQIVNPARGFGKDVQEAKKETYMTAKKINEVYGSPNYQPVILIDRPVPRYEKSAYYALAECCIVNAVRDGMNLVPYKYIVCRQGTPGMDEALGVKPEYPRTSMLVVSEFIGCSPSLSGAIRVNPWDIDAVAEALNTAITMPESEKQLRHEKHYRYVSTHDVAYWARSFVMDLDRACQDHYSKRCWGIGLGLSFRVVSLSPSFRRLAIDHICSAYRRTNRRAIFLDYDGTLVPEASIIKTPSPEVISIIKTLCDDPKNTVFIVSGRGRASLSDWLAPCEKLGIAAEHGYFIRWSKDSEWETSPVGADLEWKKIVEPVMSLYREATDGSSIETKESGLVWHHLDADPDFGSCQAKELLDHLESVLANEPAVVHRGQHIVEVKPQGVSKGLVAEKVLSRMVNGGKPPDFVMCVGDDKSDEDMFQSILTSVSNPSLPVAPEIFACTVGRKPSKARYYLDDTADVLKLLKGLATATISKPRCLPEIKVSFESNA

SEQ ID NO: 465 - DNA, 1569 bp, Medicago truncatula
atgataaagcatcaaaagcttacgagccaggtgcatgaaattgtaggacgcatcaatggaagattcggaacacttactgctgtcccaatacaccatctggaccgatcacttgactttcatgcattatgtgcactctatgctgttactgatgtagcacttgtaacatcattaagggatggaatgaatcttgtcagctatgaatttgttgcgtgtcaagcttccaagaagggggttctcattttaagtgagtttgcaggtgcagcgcagtctcttggtgctggtgctatcttggtaaatccatggaatatcacagaggttgctgcttctattggttatgctttggacatgccagctgatgaaagggaaaaacggcatcagtttaatttcaagcatgtgacaactcacacgtcacaagaatgggctgcaacttttgttagtgaactgaatgataccattgttgaagctcagcttaggacaagacaagttcctccattacttcccaataaagtggcagttgattgttactcaaaatccaataaccgattaatcatactgggtttcaatgccactcttactgaaccagtggatccttttggaaggggtggtcagattaaagaactagaactaaaagtgcacccagatatgaaggaacctttaaagaagctatctgatgacccaaagacaacagtggttgttctgagtgggagtggtagagctgtcctagacaaaaactttggtgaatacaatatgtggttggcagcagaaaatgggatgtttttgcgacttacttcaagtgaatggatgacaaccatgcctgaaaatttaaacatggattgggttgatagcgtaaagcatgtttttgagtattttactgaaagaaccccgcggtctaattttgagctacgcgagacttcagtaatatggaattataagtatgcagatgttgagtttggaaggcttcaagcaagagaccttcttcagcatctttggacaggcccaatatcaaatgcatctcttgatgttgtccaaggtggtcgatctgtcgaggtccgtgcagttggtgtgtcaaagggagcagctattgatcgtatcctgggagagatagttcatagcaaaggcatgaaggaaccaattgattacgtcctatgcattggccactttctagcaaaggatgaagatgtctataaattttttgagccagagctcccctctgaagtatctccaatggcaaaagctatgcgatcaaattcttgcagaccatcatctctgccaagattttcatccggcaaaaatggtccaaaagcatcccagtacaagaagcaacgttcactgtcaaatatagataggagagaggtcgaccctgcaagtggtgatccttggagaccaacaggtcgtgatagaacatcactacatgaaggttcttctgttcttgatcttaaaggtgacaattacttctcctgttctgttgcacgaaagagatcaagtgcccgctaccttcttaaaacctcacaagatattgtcaatctcttaagtgacctggcggatcgttcttcatctccatcaacttga

SEQ ID NO: 466 - protein, 522 aa, Medicago truncatula
MIKHQKLTSQVHEIVGRINGRFGTLTAVPIHHLDRSLDFHALCALYAVTDVALVTSLRDGMNLVSYEFVACQASKKGVLILSEFAGAAQSLGAGAILVNPWNITEVAASIGYALDMPADEREKRHQFNFKHVTTHTSQEWAATFVSELNDTIVEAQLRTRQVPPLLPNKVAVDCYSKSNNRLIILGFNATLTEPVDPFGRGGQIKELELKVHPDMKEPLKKLSDDPKTTVVVLSGSGRAVLDKNFGEYNMWLAAENGMFLRLTSSEWMTTMPENLNMDWVDSVKHVFEYFTERTPRSNFELRETSVIWNYKYADVEFGRLQARDLLQHLWTGPISNASLDVVQGGRSVEVRAVGVSKGAAIDRILGEIVHSKGMKEPIDYVLCIGHFLAKDEDVYKFFEPELPSEVSPMAKAMRSNSCRPSSLPRFSSGKNGPKASQYKKQRSLSNIDRREVDPASGDPWRPTGRDRTSLHEGSSVLDLKGDNYFSCSVARKRSSARYLLKTSQDIVNLLSDLADRSSSPST

SEQ ID NO: 467 - DNA, 2580 bp, Oryza sativa
atgccgacccccgcgccgtcggcatcgtcctcctcctcctcctgcggcggcggtggcggtggcgccggggccgcgtcgtcctactcctcctccccggacgaccgcatgctccgcggggagtgcggccgccgccaccccttcgcgtcgtcggcggcggtgggggccggttccccggacgccatggacacggactccgcggagccttcctccgcggcgacctccgtcgcggacttcggggcccggtcgccgttctcgccgggggccgcctcgcccgccaacatggacgacgcgggcggcgcgtcggcggcggggcacgcggcgcggccgccgctcgccgggccgcgcagcgggttccgccgcctcggcctccgcgggatgaagcagcgcctcctcgtcgtcgccaaccgcctccccgtctccgccaatcgccgcggcgaggaccagtggtccctggagatcagcgccggcggcctcgtcagcgccctcctcggcgtcaaggacgtggacgcgaagtggatcggatgggcgggcgtcaacgtccccgacgaggtcggccagcgagctctcacccgagcgctcgccgagaagagatgtataccagtgttcctggatgaggaaatcgtgcaccaatactacaacggatactgcaacaacatactctggcctctgtttcactacctgggattgccacaggaggacaggttggcgacgacgaggaatttcgagtcacagttcaacgcgtacaagcgagcaaaccagatgttcgctgatgttgtgtaccagcactacaaggaaggggatgtgatctggtgccatgattaccacctcatgttcctgcccaagtgcctcaaggatcatgacatcaacatgaaggtcgggtggttcctgcacacgccattcccttcttcggagatttaccggacgctgccctcccggtcggagctgcttcgctccgtgctctgtgctgatttagtcggatttcatacatatgattatgcaagacattttgtgagcgcatgtacaagaatacttggactggagggcactcctgagggtgtggaagaccaaggaaggctaaccagagttgctgcgtttcctattgggatagactctgaacgtttcaagcgagcattggagcttccagcagtaaaaagacacatcactgaattaacacaacgttttgatggtcgaaaggtaatgcttggtgttgaccgacttgacatgatcaaaggaattccgcaaaagattttggcctttgaaaagtttctcgaagaaaaccatgaatggaatgataaagtggttctacttcaaattgctgtgccgacaagaactgatgtccctgagtatcaaaagcttacaagtcaggtgcatgaaattgttgggcgcataaatggccgatttggaacactgactgctgttcctattcatcatctggaccgatctcttgatttccatgccttgtgtgccctttatgcagtcactgatgtggcccttgtaacatcgctgagagatggaatgaatcttgtaagctatgaatatgttgcatgccaaggatcaaaaaaaggagttttgatattgagtgagtttgctggggcagcacagtctcttggagccggtgctattttagtaaacccctggaatattactgaagtcgcagactcaatcaagcatgctttgacaatgtcatctgatgagagagaaaagcgacataggcataactatgctcatgtgacaactcacactgcacaagattgggccgaaacttttgtatgtgagttaaatgagacagttgctgaagctcagctgagaacaagacaagttccacctgatctccctagtcaagcagcaattcaacaatatctgcattccaaaaatcggttgctcatattggggttcaattcaacattgactgagccagttgaatcctctgggagaaggggtggtgaccaaatcaaggaaatggagctcaagttgcatcctgagttgaagggccctttgagagccctctgtgaggatgagcatactacagttattgttcttagtggaagtgacaggagcgtccttgatgaaaatttcggagaattcaatatgtggttagcagcagagcatggcatgtttttacgtccaactaatggagagtggatgacaacaatgcctgagcatctgaacatggattgggtagacagtgtaaagaatgtttttgaatactttacagaaagaaccccaaggtctcattttgaacaccgtgagacatcatttgtatggaattacaagtatgctgatgttgagtttggacggctccaagcaagagatatgctgcagcacttgtggacaggtccaatctcaaatgcagcagtcgatgttgttcaaggaagccgatcagttgaagttcggtctgtcggagttacaaagggtgctgcaattgatcgtattctaggagagatagttcatagcaaaagcatgattactccaattgattatgttctatgcattgggcacttcctaggaaaggtaattatgcaattaatttatatgtgcatatccgtttctttcagtgcaaggtgctttttttgtctttga

SEQ ID NO: 468 - protein, 859 aa, Oryza sativa
MPTPAPSASSSSSSCGGGGGGAGAASSYSSSPDDRMLRGECGRRHPFASSAAVGAGSPDAMDTDSAEPSSAATSVADFGARSPFSPGAASPANMDDAGGASAAGHAARPPLAGPRSGFRRLGLRGMKQRLLVVANRLPVSANRRGEDQWSLEISAGGLVSALLGVKDVDAKWIGWAGVNVPDEVGQRALTRALAEKRCIPVFLDEEIVHQYYNGYCNNILWPLFHYLGLPQEDRLATTRNFESQFNAYKRANQMFADVVYQHYKEGDVIWCHDYHLMFLPKCLKDHDINMKVGWFLHTPFPSSEIYRTLPSRSELLRSVLCADLVGFHTYDYARHFVSACTRILGLEGTPEGVEDQGRLTRVAAFPIGIDSERFKRALELPAVKRHITELTQRFDGRKVMLGVDRLDMIKGIPQKILAFEKFLEENHEWNDKVVLLQIAVPTRTDVPEYQKLTSQVHEIVGRINGRFGTLTAVPIHHLDRSLDFHALCALYAVTDVALVTSLRDGMNLVSYEYVACQGSKKGVLILSEFAGAAQSLGAGAILVNPWNITEVADSIKHALTMSSDEREKRHRHNYAHVTTHTAQDWAETFVCELNETVAEAQLRTRQVPPDLPSQAAIQQYLHSKNRLLILGFNSTLTEPVESSGRRGGDQIKEMELKLHPELKGPLRALCEDEHTTVIVLSGSDRSVLDENFGEFNMWLAAEHGMFLRPTNGEWMTTMPEHLNMDWVDSVKNVFEYFTERTPRSHFEHRETSFVWNYKYADVEFGRLQARDMLQHLWTGPISNAAVDVVQGSRSVEVRSVGVTKGAAIDRILGEIVHSKSMITPIDYVLCIGHFLGKVIMQLIYMCISVSFSARCFFCL

SEQ ID NO: 469 - DNA, 2580 bp, Physcomitrella patens
atggacaactacgaaggttctaggaacctgaatgaaaagctccacccaagtaaacaaagattactggtggttgccaatcgccttcctgtttctgcaattcgcctggagggggacaagtgggatttgcagttgagtgccggggggctcgtgagtgcactcttgggtatgcatagtttcgaaacaaggtggattggatggccaggtgtcagtgtgcatgatgagaaagggcgtgcttcgttgacggaggcattagctttgaagggttgcgttccagtgtttctagacgatgatacggtagatcaatattacaatggctactgcaacaatgtgctttggcctctcttccactacattggactgcctcaggcggatcggctcgctgcaaccaggagcttggattcgcaatttcaagcttatcagcacgcaaatagtttgttcgctaagattgttttttcacaatatcaagagggtgatgtggtctggtgtcacgattaccacctcatgtgcctcccacaaaaattgaaggagttaaatcctcacatgaaagtgggatggttcttgcacacaccattcccttcctctgaaatatatcggactttgccactacgttcagagttattgaaggctgtgctcactgcagatctcattggatttcatacttatgactacgcaagacattttgtgagcgcatgtacacgcattttggggctggagggtactccagaaggtgtcgaggaccaaggaaagcttactcgtgttgcagcttttcctataggtatcgatcctgagaggttcatttcagctctagaaacagagcaggtgaagctccatgtgaaggagttgttgcgtttctttgcaggcaggaaggtgatgttgggtgttgatcgtctcgatatgattaaagggattccccagaagctgctcgcatttgagatgtttctggaaaagaatcctcaatggcgcgagaaagtgatgcttgtccaaattgctgtgccaacccgaacagatgttcacgagtatcaacgtttgaccagtcaggtccatgaaatagttggacgtataaatggtcgctttggaacggttactttcgtgcccatcaatcacttggatcgatctttggctttccacgaattgtgtgctttgtatgccagcacagatgtggtgttggtgacttcgttgcgagatgggatgaatcttgttagctatgagtatgttgcctgccagcatatgaagaacactgaaggtgtactcgtattaagtgagtttgcaggagcagcccagtctttaggagctggggctatacttgtgaatccttggaatataagggagatgtacaaagctatcgaagaggctctgacaatgagtgatgaggaaagaaaggaacggcatcgtcacaacttcactcatgttatgacccacacggctcaggcctgggctgttaactttcttgattgcaaagatactaactatacaggttctgcgaatgctagtgagctgaacgacacctacgtggaggctgagcttcgaacgctgaatgaacctccagttttaccagtcgatactgccaaggaaagttttcggaggtgtactaatcgattacttatttttggtttcaattcgaccatcactgctgcagtggaagctccacggcgggatcagataaaggaatccaagttgggtttacacccaggcatgaaagactccctcaagactctttgctctgatcccaacactgacgttgtcatcctcagtggtagcaggctggatgtactggaagaggtctttggagaatatggaatttggctcgcagctgaaaatggaatgtatttgcgtgatcttagtggtaattggatgcccactatggagcatttgaacatggattggaaagaatatgtgcagcgtgtatttgattatttctgccaaagaacgccacgatcttatgtggagaaacgagagacatctttggtttggaattataagtatgctgatgtggattttgggaaggtccaagctcgaaacatgctccaacatctatggacaggtccgatctctaatgcagccgtggatgttgttcaagggcaaaagtcggtggaggttcgacccatcggtgtttcgaagggtgctgcaatcgatcggatcgtatttgaaatcttacgtaacaaatatcctaatggttcatacacatcaaatattcagtttgactttgtcatgtgcgtgggccattttttgagcaaggatgaagatgtgtttgcctatttcgatccggagatagtactccatagagattatcacggcagtatctattcgtactctgatagagacctgatgggagacctggtgaatgtgtcgtcagatacgtacatctcctgtgcagtgggaaagaaacgttcatccgcccgatattatttggatacagtaaacgaggtcgtctcatttgttaagtcacttgctgatgcgtgtccctgtgaattggattcagaagatcaatcggtgttatcggtcggttcagggtctggtcctcatgtgtccccatgttctgctgattcgttgcctaacggaatccctaggcatgatttatga

SEQ ID NO: 470 - protein, 859 aa, Physcomitrella patens
MDNYEGSRNLNEKLHPSKQRLLVVANRLPVSAIRLEGDKWDLQLSAGGLVSALLGMHSFETRWIGWPGVSVHDEKGRASLTEALALKGCVPVFLDDDTVDQYYNGYCNNVLWPLFHYIGLPQADRLAATRSLDSQFQAYQHANSLFAKIVFSQYQEGDVVWCHDYHLMCLPQKLKELNPHMKVGWFLHTPFPSSEIYRTLPLRSELLKAVLTADLIGFHTYDYARHFVSACTRILGLEGTPEGVEDQGKLTRVAAFPIGIDPERFISALETEQVKLHVKELLRFFAGRKVMLGVDRLDMIKGIPQKLLAFEMFLEKNPQWREKVMLVQIAVPTRTDVHEYQRLTSQVHEIVGRINGRFGTVTFVPINHLDRSLAFHELCALYASTDVVLVTSLRDGMNLVSYEYVACQHMKNTEGVLVLSEFAGAAQSLGAGAILVNPWNIREMYKAIEEALTMSDEERKERHRHNFTHVMTHTAQAWAVNFLDCKDTNYTGSANASELNDTYVEAELRTLNEPPVLPVDTAKESFRRCTNRLLIFGFNSTITAAVEAPRRDQIKESKLGLHPGMKDSLKTLCSDPNTDVVILSGSRLDVLEEVFGEYGIWLAAENGMYLRDLSGNWMPTMEHLNMDWKEYVQRVFDYFCQRTPRSYVEKRETSLVWNYKYADVDFGKVQARNMLQHLWTGPISNAAVDVVQGQKSVEVRPIGVSKGAAIDRIVFEILRNKYPNGSYTSNIQFDFVMCVGHFLSKDEDVFAYFDPEIVLHRDYHGSIYSYSDRDLMGDLVNVSSDTYISCAVGKKRSSARYYLDTVNEVVSFVKSLADACPCELDSEDQSVLSVGSGSGPHVSPCSADSLPNGIPRHDL

SEQ ID NO: 471 - DNA, 2769 bp, Populus trichocarpa
atgcctggaaaccagtacaacggtaactctacccttaactcaggtcgtgtcggacggctcttaaagataagagagcaaaggagaagtatcaggtctgcctattcaaatgaggtaactgataaccatagaggaactgaagcatgtgaaaatgatttgcgcacgcgagaaggtgacagcttaaacaattcatttatcgaacaatacttggaaggtgctatcgcagagggatatgaaaagctggatgtcaggcctttaaggcaacggctgttggtggtagctaatagactacctgtatctgcagttagaagaggtgaagactcatggtctttggagataagtgctgggggcttagtcactgctcttctaggtgtaaaggagtttgaggcgaaatggattggttgggctggagttaatgtgccagatgaagttggccagaaggcgcttactgaagctttggctgaaaagaggtgtattccggtattccttgacgaagagattgttcatcaatattataatggctactgcaacaatatattgtggcccctctttcattaccttgggcttccacaagaagatcgacttgccacgaccagaagtttccagtctcagtttgctgcatataagaaggcaaaccaaatgtttgctgatgtggtgaatcagcactatgaggagggtgatgttgtctggtgccatgattaccatttgatgtacctcccaaaatgccttaaggaatacaataataatatgaaagttggttggtttctccacacaccctttccttcttctgaaatccataggacgctgccatctcgatcagacctactacgttctgttcttgcagccgatttagttgggtttcacacctatgactatgcaagacattttgttagtgcttgtactcgtattcttgggctagagggcacacctgaaggcgttgaggatcaagggaggctgactcgagttgctgcgtttcccattgggatagactcagatcggttcataagagctcttgaactccctcaagtccaggaacacatcaaagaactgaaggaaagatttgctggccgaaaggtaatgctaggtgttgaccgccttgatatgattaaaggaattccacagaagattcttgcatttgaaaaatttctcgaggagaattccgcctggcgtgataaagttgttctactgcagattgctgtgccaacaagaacagatgttcctgagtatcaaaaacttacaagccaagttcatgaaattgttggacgcattaatggcagatttggaacattaactgctgttccaatacaccacctggatcgctctctcgacttccatgccttgtgtgctttatatgcagttaccgatgttgctcttgtaacttctttaagggatggaatgaatctcgtcagttatgagtttgtagcatgccaagattcgaagaaaggtgtgctcattcttagtgagtttgcaggtgcagcccaatctctaggtgctggagcaatccttgtgaatccttggaacatcactgaagttgctgattcaatacgccaagctctaactatgtcccctgaagaaagagagaagcgacatcgccacaactttgtccatgtgacaacccacactgctcaagaatgggctgaaacttttgtgagtgaactagatgatacagttatcgaggcacaactaaggaccaagcaagtgccacctgcacttccagaagaagatgcaattagtcgttatttgcagtctactaatcgattgctcatactgggattcaatgcaacattgactgagccagcggacactcctgggagaagagctgatcaaattaaagaaatggaacttaaattgcacccagagttaaaagaagcattgacagcactttgcagtgatagaaagacaaccattgttgttctcagtgggagtgaccgaaaaacattagatgataactttggggagtatgacatgtggttggcagcagaacatggaatgtttttgcgacttacaaagggagaatggatgacaacaatgccagaacacttaaatatggaatgggttgacagtgtgaagcatgtttttgagtacttcacagaacgtactccccgatcacattttgaacgctgtgaaacatcacttgtatggaattacaagtatgcagatgttgaatttgggaggcttcaagcaagggatatgttgcaacacctctggacgggcccaatttcaaatgcctctgttgatgtggtccaagggaatcgatcagttgaggttcgagcagttggtgttacaaagggtgctgctattgatcgtatactgggagagattgtccatagtaaatccatgacaacaccaattgattatgtcctatgcattggccattttctgggaaaggatgaagatgtgtacaccttctttgagccagagctcccttctgatggcctagttgctgcaagaacaaagcaaaatgatggaccaaaattacccaatgatagacgaccttctatgaagcttccagccattagaagcgtgtctaaatcatctcaaggtaaggcacagcgacctttactaaatcccgagaagagaacagctaaccacggctgtgggagtgggcgacggccatcagcagaaaagatttcatggaacgtgcttgatctcaagggagataattacttctcctgtgctgttggtcgaactcgcacaaatgctcgctatctacttggatcatcagatgatgtcgtgtccttcctaatgaaattagccaatgcatctacgtga

SEQ ID NO: 472 - protein, 922 aa, Populus trichocarpa
MPGNQYNGNSTLNSGRVGRLLKIREQRRSIRSAYSNEVTDNHRGTEACENDLRTREGDSLNNSFIEQYLEGAIAEGYEKLDVRPLRQRLLVVANRLPVSAVRRGEDSWSLEISAGGLVTALLGVKEFEAKWIGWAGVNVPDEVGQKALTEALAEKRCIPVFLDEEIVHQYYNGYCNNILWPLFHYLGLPQEDRLATTRSFQSQFAAYKKANQMFADVVNQHYEEGDVVWCHDYHLMYLPKCLKEYNNNMKVGWFLHTPFPSSEIHRTLPSRSDLLRSVLAADLVGFHTYDYARHFVSACTRILGLEGTPEGVEDQGRLTRVAAFPIGIDSDRFIRALELPQVQEHIKELKERFAGRKVMLGVDRLDMIKGIPQKILAFEKFLEENSAWRDKVVLLQIAVPTRTDVPEYQKLTSQVHEIVGRINGRFGTLTAVPIHHLDRSLDFHALCALYAVTDVALVTSLRDGMNLVSYEFVACQDSKKGVLILSEFAGAAQSLGAGAILVNPWNITEVADSIRQALTMSPEEREKRHRHNFVHVTTHTAQEWAETFVSELDDTVIEAQLRTKQVPPALPEEDAISRYLQSTNRLLILGFNATLTEPADTPGRRADQIKEMELKLHPELKEALTALCSDRKTTIVVLSGSDRKTLDDNFGEYDMWLAAEHGMFLRLTKGEWMTTMPEHLNMEWVDSVKHVFEYFTERTPRSHFERCETSLVWNYKYADVEFGRLQARDMLQHLWTGPISNASVDVVQGNRSVEVRAVGVTKGAAIDRILGEIVHSKSMTTPIDYVLCIGHFLGKDEDVYTFFEPELPSDGLVAARTKQNDGPKLPNDRRPSMKLPAIRSVSKSSQGKAQRPLLNPEKRTANHGCGSGRRPSAEKISWNVLDLKGDNYFSCAVGRTRTNARYLLGSSDDVVSFLMKLANAST

SEQ ID NO: 473 - DNA, 2781 bp, Solanum lycopersicum
atgccagggaacaagtataccggcaaccaagcggttgctagcactcgattggagaggctattgagagaaagagagcttaggaaaagtagcaaagtttctcactttccaaatgaatctactgataacaataggggaaacgagctctctgaccatgattttcgccaaggagaagctgataatggaggagtttcatatgtcgaacagtacctcgaaggagctgcactagcatataatgaaggatgggagcggcctgatggaaagcccaccagacaacgactcttggttgtggcaaacaggttacctgtctctgcagtaaggagaggcgaggaatcctggtctctagagataagtggtggaggtcttgttagtgctcttcttggtgtgaaggagtttgaggctagatggattggttgggcaggtgtgaatgtgccagatgaggctgggcagagggcacttactaaggcactggcagaaaagaggtgtatccctgtattcctggatgaagaaattgttcatcagtattacaacggttactgcaacaatatattgtggcctcttttccattatcttggacttccgcaagaagaccgccttgcgactaccagaagtttccagtctcagtttgctgcttataagaaagcaaatcaaatgtttgctgatgttgtgaatgaacattacgaagaaggtgatgtggtatggtgtcatgactaccatctcatgttcctgccaaaatgtctcaaggattacaacagccaaatgaaagtcggttggtttctacacacaccctttccatcctcggaaatacacaggacactgccgtctagatcagagctgctccgagcagttcttgctgctgacttggttggttttcatacctatgactatgcaaggcattttgttagtgcatgtactcgtatcctgggacttgaaggaacacctgaaggagtagaagatcaaggtagactgacccgcgttgctgcgtttcctattggtatagattcagaacgatttattcgagcacttgaagttactcaagttcaggaacacataaaagaactaaaagagagatttgctgggagaaaggttatgctaggagttgatcgccttgatatgattaaaggaattccccaaaagatcctggcatttgagaagttccttgaagaaaatccgtactggcgtgataaagtggttttgcttcaaattgctgtgccaacaagaacagatgttcctgaataccaaaaacttaccagtcaagttcatgagattgttggacgcatcaatggtcggtttggaactttgactgcagtgcctattcatcatctggaccgttctcttgactttcatgcattatgtgcactgtatgctgtaactgatgtagcgttggttacctctttaagagatggcatgaacctcgtcagctatgaatttgtagcctgccaagagttgaaaaaaggggtccttattctcagcgaatttgctggtgctgcacaatcgttaggtgctggagcaattctggtgaatccatggaatataacagaggttgctgcttcgattgggcaagctttaaatatgtcagctgaagaaagagaaaaacgccacaggcataactttctgcatgtgactacgcatactgctcaagaatgggctgagacttttgtgagtgaactaaatgatactgttattgaagctcaacagaggataagaaaagttccgccccggcttaacatcagtgatgcaattgagcgctattcgttttccaataatcgactactaatattgggtttcaattctacactgacagaatcggtggatacccctggaagaagaggtggagatcaaatcaaagaaatggaactgaaattgcatcctgagttgaaagaatcattgctcgcgatttgtaacgacccaaagacaacagtcgttgtcctcagtggaagtgatagaaacgtcttagatgataacttcagcgagtacaacatgtggttagcagcagaaaatggaatgtttttacgatctacaaacggtgtatggatgacaactatgccagaacacctaaacatggactgggttgatagtgttaagcacgttttcgagtacttcactgaaaggacaccgagatctcactttgaacaacgtgaaacttcacttgtttggaattacaagtatgcagatgttgaatttggaagattgcaagctagagacatgcttcagcatctctggacaggtccaatatcaaatgcatctgttgatgttgtacaaggactccgctccgttgaggttcgagcagttggtgttacaaagggagcagcaatagatcgtatactgggggagatcgtacacagtaaagccatcgcaacaccaattgattacgttttatgcatagggcattttctggggaaggatgaggatgtatatacattttttgagccagagcttccttctgactgcatcggtatgccaagaagtaaggtcagtgatgcaccaaaggtgcccggggaaaggcgatcagttccaaaactcccttctagtcgaactagctcaaagtcatctcagaataggaacagaccagtttcaaactcggataagaagacttccaatgggcgacggccctcacctgaaaatgtgtcatggaatgtgctggatctgaagaaggagaattacttctcttgtgcagttggaaggactcgtacaaacgctcggtatctgctcagtacgccagacgacgttgttgcttttctaagggaactagctgaagcacctatttcaaatgggacatcatga

SEQ ID NO: 474 - protein, 926 aa, Solanum lycopersicum
MPGNKYTGNQAVASTRLERLLRERELRKSSKVSHFPNESTDNNRGNELSDHDFRQGEADNGGVSYVEQYLEGAALAYNEGWERPDGKPTRQRLLVVANRLPVSAVRRGEESWSLEISGGGLVSALLGVKEFEARWIGWAGVNVPDEAGQRALTKALAEKRCIPVFLDEEIVHQYYNGYCNNILWPLFHYLGLPQEDRLATTRSFQSQFAAYKKANQMFADVVNEHYEEGDVVWCHDYHLMFLPKCLKDYNSQMKVGWFLHTPFPSSEIHRTLPSRSELLRAVLAADLVGFHTYDYARHFVSACTRILGLEGTPEGVEDQGRLTRVAAFPIGIDSERFIRALEVTQVQEHIKELKERFAGRKVMLGVDRLDMIKGIPQKILAFEKFLEENPYWRDKVVLLQIAVPTRTDVPEYQKLTSQVHEIVGRINGRFGTLTAVPIHHLDRSLDFHALCALYAVTDVALVTSLRDGMNLVSYEFVACQELKKGVLILSEFAGAAQSLGAGAILVNPWNITEVAASIGQALNMSAEEREKRHRHNFLHVTTHTAQEWAETFVSELNDTVIEAQQRIRKVPPRLNISDAIERYSFSNNRLLILGFNSTLTESVDTPGRRGGDQIKEMELKLHPELKESLLAICNDPKTTVVVLSGSDRNVLDDNFSEYNMWLAAENGMFLRSTNGVWMTTMPEHLNMDWVDSVKHVFEYFTERTPRSHFEQRETSLVWNYKYADVEFGRLQARDMLQHLWTGPISNASVDVVQGLRSVEVRAVGVTKGAAIDRILGEIVHSKAIATPIDYVLCIGHFLGKDEDVYTFFEPELPSDCIGMPRSKVSDAPKVPGERRSVPKLPSSRTSSKSSQNRNRPVSNSDKKTSNGRRPSPENVSWNVLDLKKENYFSCAVGRTRTNARYLLSTPDDVVAFLRELAEAPISNGTS

SEQ ID NO: 475 - DNA, 2325 bp, Triticum aestivum
atggacttcgtctacatcggcggcctgcgcgacgacatcccggcggaggagcaggacaaggtcgcgctcgagctctacgaccgcttccgctgcgtgcccgccttcctgccggacgacctccgctcccgcttctaccacggcttctgcaagcagcagctgtggccactgttccattacatgctgccactgtcgcccgagctcggcggccgctttgaccgcgacctgtggaaggcctacctgtccgtcaacaagatcttcaccgacaagatcatggaggtgatcaaccccgaggaggacttcgtctgggtgcacgactaccatctcatgctcctgcccaccttcctgcgcaagaaattcaaccgtgtcaggctgggcttcttcctgcacagcccgttcccatcatcggagatctacaagaccctgccggtgcgcgaggaggtgctccgggcgctgctgaatgccgacttgattgggttccacacatttgattatgccaggcatttcctctcatgctgcagcaggatgctgggaatgaaatacgagtcgcagaggggatacattggactggagtattatggacggactgtcactgtcaagatactgccggtggggatacatttgacgcagctgcaggcagtgctcaacctcccggagaccgggctcaaggtcgccgagcttatgaaggagttccctgatcgtcaccgcatcatgatgcttggtgtggatgacatggacatatttaaaggcatcagtctgaagcttctggcatttgaggagctcttgacgcagcatccagagtatcgaggaaaggtggtgctggtacagattgccaatccggcgagggggaagggaaaggatgtgaaggaggtacaggatgagagctatgccatggtgaagcgcatcaatgaggcatttgggcagccagattaccagccagtcatattgatcgacaggccactgcacttctatgagaggatggcatactatgttgttgctgagtgctgcttggtgaccgcggtgagggatggcatgaatcttataccatatgagtacatcattgctaggcaagggaatgagaagattgacaggatcctgggtctcagccctttcacaaggaagaagagcatgcttgtcgtgtcggaattcattggctgctcaccctccctgagtggcgcgattcgggtgaacccttggaacattgagtcggtggccgaggcaatggacaaggccttgcacacaggtgaaggtgagcaggcgctgaggcacgagaagcatcacaaatttgtgagcacacatgatgtcggatactgggcaaacagcttcctgcaggatctggcgaggacttgccaagaccataacaagaggcgctgctggggcataggatttgggctaaggttcagggttgtggcccttgatacgagcttcaagaagctcgcggctgagcagcttgtctcagcctaccggaaggcaagcacgcgcgccattctcttggactatgatggtacgctgatgcctcagtcatcgtttggtaagatgccgagctccaaaacaataaacatgttgaacagcctctgtcgcgatgagaagaacttggtcttaatcgcaagcacaaagacccgggcgaccttaagtgaatggttctcagcatgtgaggacctaggccttgctgctgagcatggctacttcatcaggctggaaagagatgcagaatgggagacatgcggcctgtcaacagacttcagctggaagcaaatcgcggagccggtgatgaagacctacaccgagacaacggacgggtcgatcatcgaggacaaggagacagcaatcgtgtggtgctacgaggacgcggaccatgattttggatcttgccaggccaaggagctccatgatcacctggagagtgtcctctccaacgagccggtatcagtcaaagctgacctgcactatgttgaggtgaagccacagggtgtgagcaagggcctggtggcgaagcggatgctgtcgacaatgcaggagctggggctccagcccgacttcatcctctgcgtcggggacgaccgctccgacgaggacatgttcgaggtgatcaccaccgcggtggacggcccctacctgagcccttccgcgacggtcttcgcctgcaccatcggccaaaagcccagcaaggccaagtactacctggatgagcccgccgacatcaagcgcatgatccgggccctcgcgagcgtctctgaccaggagctggcgatggaggagggcgaagaccctccttaccctttcctcgccggcgacggcaccagcagcgacgacacctggctggactga

SEQ ID NO: 476 - protein, 774 aa, Triticum aestivum
MDFVYIGGLRDDIPAEEQDKVALELYDRFRCVPAFLPDDLRSRFYHGFCKQQLWPLFHYMLPLSPELGGRFDRDLWKAYLSVNKIFTDKIMEVINPEEDFVWVHDYHLMLLPTFLRKKFNRVRLGFFLHSPFPSSEIYKTLPVREEVLRALLNADLIGFHTFDYARHFLSCCSRMLGMKYESQRGYIGLEYYGRTVTVKILPVGIHLTQLQAVLNLPETGLKVAELMKEFPDRHRIMMLGVDDMDIFKGISLKLLAFEELLTQHPEYRGKVVLVQIANPARGKGKDVKEVQDESYAMVKRINEAFGQPDYQPVILIDRPLHFYERMAYYVVAECCLVTAVRDGMNLIPYEYIIARQGNEKIDRILGLSPFTRKKSMLVVSEFIGCSPSLSGAIRVNPWNIESVAEAMDKALHTGEGEQALRHEKHHKFVSTHDVGYWANSFLQDLARTCQDHNKRRCWGIGFGLRFRVVALDTSFKKLAAEQLVSAYRKASTRAILLDYDGTLMPQSSFGKMPSSKTINMLNSLCRDEKNLVLIASTKTRATLSEWFSACEDLGLAAEHGYFIRLERDAEWETCGLSTDFSWKQIAEPVMKTYTETTDGSIIEDKETAIVWCYEDADHDFGSCQAKELHDHLESVLSNEPVSVKADLHYVEVKPQGVSKGLVAKRMLSTMQELGLQPDFILCVGDDRSDEDMFEVITTAVDGPYLSPSATVFACTIGQKPSKAKYYLDEPADIKRMIRALASVSDQELAMEEGEDPPYPFLAGDGTSSDDTWLD

SEQ ID NO: 477 - DNA, 2742 bp, Zea mays
atgatgtcgcggtcgtacaccaacctgctcgacctcgcggagggcaacttcgcggcgctgggcccggccgccggcgccggcggcagcgggcggcagaggcatgggtcgttcgggctgcggcggatgtcgcgggtgatgacggtgccggggacgctgacggagctcgacggcgaggacgagtcggagccggccgcgaccagcagcgtcgcctccgacgtgccctcgtccgtggcggcggaccgcctcatagtggtctcgaatcagttgcccatcgtcgcgcgccgcaggcccgacggccgagggtggtccttctcgtgggacgatgactcgctcctgctccagctccgcgacggcattcccgacgagatggaggtgctcttcgtcggatcactccgcgccgacgtccccgcagccgagcaggacgcggtatcgcaggcgctgctcgaccgattccgctgcgcgccggtgttcctccctgaccacctcaacgaccggttctaccacggcttctgcaagcgccagctctggcctctgttccactacatgctccccttctcatcgcccgcttccgcgtctgccgccgctacctcttcctccgtcgccacttcgtcacccggcaacggttgcttcgaccgcagcgcttgggaggcatacgtgctcgccaacaagttcttctttgagaaggtcgtcgaggtaatcaacccggaggatgactacgtctgggttcacgactaccatctcatggcgctgcctaccttcctccgccgctgcttcaaccgcctccgcatcggattcttcctccacagccccttcccctcgtccaagatctaccgcaccctccctgttcgggaggagatactcaaggcgctgctcaactgtgacctaattggcttccacacttttgattacgccaggcacttcctctcgtgctgcagtaggatgctgggaattgaataccagtcaaagcgtgggtacattgaattggattactttggccgcactgtcgggatcaaaatcatgccagtgggagttcatatgggtcaattggagttgggtctgcgcttgcctgatagggaatggaggctttctgagcttcaacgccagtttcaggggaaaactgtcttgcttggtgtggatgatatggatatctttaaggggatcaatttgaagcttctcgcctttgagaacatgttgaggacacatcccaagtggcaggggagagcagtgttagtgcagattgctaacccagcccgtggaaggggtaaagatctggaagccatccaggctgagattgaggagagctgccagcggatcaatggagactttggccagtcagggtatagccctgttgttttcatcgatcgtgatgtgtcaagtgttgagaagattgcctattatacgatagcggaatgtgtggtggtgactgctgtgagggatgggatgaacttgacaccgtatgaatacgttgtctgtaggcagggtgcaccaggatctcagtcggtagcagaggtgagtgggccaaagaagagcatgctggttgtgtcagagtttattggctgctcaccgtcactgagcggtgctattagggttaacccatggaatatagaggcaaccgcggaggcgatgaatgaggccatttcaatgccagaacaggaaaaacagttgaggcatgagaaacattaccgttatgtcaggagccatgacgtcgcttattggtcaaagagcttcatcatagacttggaaagggtttgtaaggatcacttcaagaggacttgttggggcatagggttgggttttggtttcagggtggtggccttggaccctcatttcacaaagcttaacatggattcaatcattaatgcttatgagctttcagagagcagggctatattgctcgattatgatggaactctggttccccaaacttccctcaacaaggaacctagtccacaggttttgagcatcatcaataccctttgctcagatagtagaaacatcgtttttcttgtcagtggtcgagacaaagataccttgggaaagtggttctcctcatgtccaagattggggattgcagctgaacatggttacttcttgaggtggtctagagaagaagagtggcaaacatgcactcaggcattggacttcggatggatgcaaatggcgaagccagtgatgaatttatatacagaagcaactgatggatcctacattgaggccaaggaaagtgccttggtgtggcaccatcaggatgctgacctaggctttggatcctcacaggcaaaggagatgcttgatcacctggaaagtgtactagcaaatgaaccagtctctgtcaagagtggccagttcattgttgaagtcaaaccacagggaataagcaaaggaatagttgctgagaggatacttgcatcagtgaaggagagaggaaagcaggctgatttcttattgtgcatcggcgatgataggtctgatgaggacatgtttgaaaatattgctgatatcactgggaggaatttggttgctccaagaacagcactgtttgcgtgcactgtgggacaaaaaccaagcaaagccaaattctatctggatgatacattcgaagtggtcactatgctgagcgcactggcagatgccacaggtcctgagactgattcggctgatgaatctgtcgcatatatctcatcacttgatattggtgacgaacaatcagaatccagtgataaaccagttgaagggtcttag

SEQ ID NO: 478 - protein, 913 aa, Zea mays
MMSRSYTNLLDLAEGNFAALGPAAGAGGSGRQRHGSFGLRRMSRVMTVPGTLTELDGEDESEPAATSSVASDVPSSVAADRLIVVSNQLPIVARRRPDGRGWSFSWDDDSLLLQLRDGIPDEMEVLFVGSLRADVPAAEQDAVSQALLDRFRCAPVFLPDHLNDRFYHGFCKRQLWPLFHYMLPFSSPASASAAATSSSVATSSPGNGCFDRSAWEAYVLANKFFFEKVVEVINPEDDYVWVHDYHLMALPTFLRRCFNRLRIGFFLHSPFPSSKIYRTLPVREEILKALLNCDLIGFHTFDYARHFLSCCSRMLGIEYQSKRGYIELDYFGRTVGIKIMPVGVHMGQLELGLRLPDREWRLSELQRQFQGKTVLLGVDDMDIFKGINLKLLAFENMLRTHPKWQGRAVLVQIANPARGRGKDLEAIQAEIEESCQRINGDFGQSGYSPVVFIDRDVSSVEKIAYYTIAECVVVTAVRDGMNLTPYEYVVCRQGAPGSQSVAEVSGPKKSMLVVSEFIGCSPSLSGAIRVNPWNIEATAEAMNEAISMPEQEKQLRHEKHYRYVRSHDVAYWSKSFIIDLERVCKDHFKRTCWGIGLGFGFRVVALDPHFTKLNMDSIINAYELSESRAILLDYDGTLVPQTSLNKEPSPQVLSIINTLCSDSRNIVFLVSGRDKDTLGKWFSSCPRLGIAAEHGYFLRWSREEEWQTCTQALDFGWMQMAKPVMNLYTEATDGSYIEAKESALVWHHQDADLGFGSSQAKEMLDHLESVLANEPVSVKSGQFIVEVKPQGISKGIVAERILASVKERGKQADFLLCIGDDRSDEDMFENIADITGRNLVAPRTALFACTVGQKPSKAKFYLDDTFEVVTMLSALADATGPETDSADESVAYISSLDIGDEQSESSDKPVEGS

SEQ ID NO: 479 - DNA, 795 bp, Brassica napus
atgatggagtgggataacaatcaaaagcagcaacccaacaaccacaactcctcaaatctccaggggatcgacgttagtggcggcggctccagctcaggaggaatgtacgtgaaagtgatgaccgacgagcagctcgagactctgaggaagcagattgctatctacgccaccatttgtgatcgtctcgttgagatgcacaaaaccctcacttctcaacaagatcttgcaggagggagactgggaggtctatatgtagacccaaccattggtcacaagatgacagctaggcagaggtggactcctacccccgtgcagcttcagattctggagcgtatattcgaccaaggcacgggaacgccgagtaagcaaaagatcaaagacataaccgaagagcttagccagcacggccagatttcggaacaaaacgtctacaattggttccagaaccgacgtgctcgttccaagaggaagcagcatggtggtggtgttggtggttcttctaacaacaacaatggtgagtctgaggtggagactgaggctgagacgttgaatgggaagaggaagatgccagagagtcttcgtgttcttcctaatggaaacaatggcattgggacaacaagaggtactagtcctaggcctgaagatctttgcttccagagccctgagatgagctctgatcttcacttgctaggagtcctatcaaacccaagggatgatcatcttgtaggaaagatgggattgtctgaaagttacaacctctatgatcatgttgaggactatggcatgtcaggctga

SEQ ID NO: 480 - protein, 264 aa, Brassica napus
MMEWDNNQKQQPNNHNSSNLQGIDVSGGGSSSGGMYVKVMTDEQLETLRKQIAIYATICDRLVEMHKTLTSQQDLAGGRLGGLYVDPTIGHKMTARQRWTPTPVQLQILERIFDQGTGTPSKQKIKDITEELSQHGQISEQNVYNWFQNRRARSKRKQHGGGVGGSSNNNNGESEVETEAETLNGKRKMPESLRVLPNGNNGIGTTRGTSPRPEDLCFQSPEMSSDLHLLGVLSNPRDDHLVGKMGLSESYNLYDHVEDYGMSG

SEQ ID NO: 481 - DNA, 1035 bp, Glycine max
atgaaaatttcagaatcaatcttatattttgggactaaatcttttccaaaatatattttcttgattccaaaagaacctaggaatacaaaccctatccttggtctgttccttcattcttattgtctccccgcatcgtacgccgccgacacagcttcgaatcgctgccaagtgctaacaaacgcctctgagtctctgacaccaacgcaactctctctgctcacatgtttgaaggagatggtgaacgtgatggagtggcagaagcagcgttggcaaccgaatgggaacgcggaaatgatgtacgtgaaagtgatgaccgacgaacagctcgagactctgcgcaaacagattgcagtttacgcaaccatctgtgaacaactcatcgaaatgcacaaaaacatctcctcgcaccaagatcttgcagggattaggctggggaatatgtattgtgatccattgttggggtctggtgggcacaaaatagcttcaaggcagcggtggactccgtccgctatgcagcttcagattcttgagcgaatatttgatcaagggactggaacccccaccaaggaaaagatcaaggagatcactaatgagctcagccagcatggccagatttctgagaccaatgtgtataattggttccagaacaggcgtgctcgctccaaaagaaagcagcagaatgtggcacctagtgctaatgctgaatcggaagtggagactgaggttgattctaaggataagaagacaaagccggacgaatttcagtcccctcctagcgtttctgctgtgcctgctgatgataatttaggcttccagaaccatggcagtttgcagtacttgaatccagagtccaacaaaccagattctgtgttcccatctgatgcaagtttaagatctacaagaaatttcaatcatgtgcctgtttttgatgggctgctatcgaactcaaggagtgactatcttactggaaaaatggaagcacctgagaactacgacttataccagccagcaggcgacttcaacatggcaggttga

SEQ ID NO: 482 - protein, 344 aa, Glycine max
MKISESILYFGTKSFPKYIFLIPKEPRNTNPILGLFLHSYCLPASYAADTASNRCQVLTNASESLTPTQLSLLTCLKEMVNVMEWQKQRWQPNGNAEMMYVKVMTDEQLETLRKQIAVYATICEQLIEMHKNISSHQDLAGIRLGNMYCDPLLGSGGHKIASRQRWTPSAMQLQILERIFDQGTGTPTKEKIKEITNELSQHGQISETNVYNWFQNRRARSKRKQQNVAPSANAESEVETEVDSKDKKTKPDEFQSPPSVSAVPADDNLGFQNHGSLQYLNPESNKPDSVFPSDASLRSTRNFNHVPVFDGLLSNSRSDYLTGKMEAPENYDLYQPAGDFNMAG

SEQ ID NO: 483 - DNA, 759 bp, Gossypium hirsutum
atgagtgaaagtttcatgataatggaatgggaagatcaagagaatcaaaaccagagagagattttgaatgtaaatgtgaataatggtggagtaatgtatgtcaaagtgatgaccgatgaacagttggagactctcagagagcaaattgctgtttatgccgccatttgtgagcagctcgttgagatgcataagaacctcactgcccagcaagatctcgcaggtggtaggctggggagcctgtattgtgacccgttaatgacatctgctggtcacaaaattactgctagacagcggtggactccaactccagtgcagcttcagattctggaacgaatctttgatcaggggactggaactccaagcaagcaaaagatcaaagagataacctcagaactgagccagcatggccaaatttctgaaacaaatgtctataactggtttcaaaatagacgggctcggtctaaaaggaagcaactggggtcatcatccaacaatgctgaatcagaactagagacagaagtcgagtcaccgaatgaaaagaagacgaagcccgagaatcttctctctgggcagaaccctgcaccaagggctgaagatctctgtttccagaaccctgagataacctctgaactgcatttcttgggtgtaatgtccaatccaactacattcaacggaggtgaacatctgtctggaaaaatgggaatgcctgggagctacaacatttttgaccaggcaggtgactacggcatggcagggtga

SEQ ID NO: 484 - protein, 252 aa, Gossypium hirsutum
MSESFMIMEWEDQENQNQREILNVNVNNGGVMYVKVMTDEQLETLREQIAVYAAICEQLVEMHKNLTAQQDLAGGRLGSLYCDPLMTSAGHKITARQRWTPTPVQLQILERIFDQGTGTPSKQKIKEITSELSQHGQISETNVYNWFQNRRARSKRKQLGSSSNNAESELETEVESPNEKKTKPENLLSGQNPAPRAEDLCFQNPEITSELHFLGVMSNPTTFNGGEHLSGKMGMPGSYNIFDQAGDYGMAG

SEQ ID NO: 485 - DNA, 681 bp, Medicago truncatula
atgatggaatggcagaaacaacaagtacagaatgggaatgtcgaagcgatgtatgttaaggtgatgactgatgaacaattggaaactttgaggaaacaaattgctgtttatgctaccatttgtgaacaacttgttgagatgcataaaacactctctgctcaacaagatcttgctggggttaggttggggaatttatactgcgactcattgatgacagctggtcacaaaatcacatccagacagaggtggactcctacaccggttcagctccagattcttgagcgtatattcgatcagggaaatggaactccaagcaaagaaaaaatcaaggagattgctactgaactcagccagcatggccaaatttctgaaacgaatgtttataattggttccaaaataggcgtgctagatcgaaaagaaaaatgcaaaatgggggaactagtaacactgaatcagaggtagagactgaggttgattccaaggataagaagacaaaaccagaggaatttcattctcaacaaagtgctgctctaggggatgaaaatttgtgcttccagaaccaagaaaaatgctctgaattgcagtacttgaatcatggttctaacaaaacatatttctgtgtttccatcggatggcggtataagatccacaagaaatttgagtggcgtatctctttatga

SEQ ID NO: 486 - protein, 226 aa, Medicago truncatula
MMEWQKQQVQNGNVEAMYVKVMTDEQLETLRKQIAVYATICEQLVEMHKTLSAQQDLAGVRLGNLYCDSLMTAGHKITSRQRWTPTPVQLQILERIFDQGNGTPSKEKIKEIATELSQHGQISETNVYNWFQNRRARSKRKMQNGGTSNTESEVETEVDSKDKKTKPEEFHSQQSAALGDENLCFQNQEKCSELQYLNHGSNKTYFCVSIGWRYKIHKKFEWRISL

SEQ ID NO: 487 - DNA, 609 bp, Oryza sativa
atggagtgggacaaggccaaggcgtcctccggcgaggcggtggacgacaggggcagaggggaaggagggctcgggtacgtgaaggtgatgacggacgagcagatggaggtgctccggaagcagatctccatctacgccaccatctgcgagcagctcgtcgagatgcaccgcgccctcaccgcgcagcaggactccattgcaggaatgaggcttggtaatctgtactgtgatcctctaatggttcccggaggtcacaagatcacagcaaggcagcgatggacaccaaccccaatgcagttgcagattcttgagaacatctttgaccaaggcaatggaacaccaagcaagcaaaagataaaggacataacagcagagctctcacagcatggccagatctcagagacaaatgtctataactggttccagaacaggcgggcacgatcgaaacggaagcaagctgctttaccaaataataatgcagaatctgaagctgaagcggatgaggagtccccaactgacaaaaaacccaaatcagataggccgcttcaccagaacatagccatgagagatcacaatagcgaaaggatcctcggagatgcaccacgttga

SEQ ID NO: 488 - protein, 202 aa, Oryza sativa
MEWDKAKASSGEAVDDRGRGEGGLGYVKVMTDEQMEVLRKQISIYATICEQLVEMHRALTAQQDSIAGMRLGNLYCDPLMVPGGHKITARQRWTPTPMQLQILENIFDQGNGTPSKQKIKDITAELSQHGQISETNVYNWFQNRRARSKRKQAALPNNNAESEAEADEESPTDKKPKSDRPLHQNIAMRDHNSERILGDAPR

SEQ ID NO: 489 - DNA, 855 bp, Physcomitrella patens
atggaatctgaatctaggttaggtcgaatgatggacatgacacctttggggtcgggattgcaagggcaacctgttcctggtggagctgcgctcggccttgggccttcgttggagaattcgttgccgcaacccatgtacactcgggggtctgggcaggtaatgacagaagagcagctcgaaacattgcgacgacagatttcggtgtatgcaacaatctgtcaacaacttgttgaaatgcacaaagcgagtgtttcacaacaagcatctcttcctggcattctagcaagtggtcagattgtgtcgatggaccatctcactggaacaccccctcacaaatcgacagcaagacagcggtggacccccagccaacatcagctgcaaattttagaaaagttgtttgagcaaggcagtggcacacccaacaaacagcgcattaaagagattactgccgaactcagtcagcatggtgcaatctcggagacaaatgtgtacaactggtttcagaatcgcaaagcccgagccaaaaggaagcagcaattggttaccccaagggatggtgaatcggaagcagatacagatgtagagtcaccaaaggaaaaacgtacaagacaggaaggtgaacaaaatcaggacgaatcagggggtgttggtgatacaaatggtggaggcaactctgatggagctggaaatggggttcctgagcaaagagctgccaactttgaccagcaggatgccgcttcgtctgcgctgctgcattcacaaacagatactaaacctgatatatcatcatttaacaggagtgctgggttcgatcctcataatgtatctcaaggcatccctcccatgatgagttaa

SEQ ID NO: 490 - protein, 284 aa, Physcomitrella patens
MESESRLGRMMDMTPLGSGLQGQPVPGGAALGLGPSLENSLPQPMYTRGSGQVMTEEQLETLRRQISVYATICQQLVEMHKASVSQQASLPGILASGQIVSMDHLTGTPPHKSTARQRWTPSQHQLQILEKLFEQGSGTPNKQRIKEITAELSQHGAISETNVYNWFQNRKARAKRKQQLVTPRDGESEADTDVESPKEKRTRQEGEQNQDESGGVGDTNGGGNSDGAGNGVPEQRAANFDQQDAASSALLHSQTDTKPDISSFNRSAGFDPHNVSQGIPPMMS

SEQ ID NO: 491 - DNA, 747 bp, Populus trichocarpa
atggactgggacaacaatcaagaaaatcaccaggacagtcatcaaaatcaaagagagtgtagaaatgggattaacgggactaatgtgaatgtgaatggtaatggtggaactaatatgttgtatgtgaaagttatgacagatgaacaactggaaactttaaggaagcaaattgctgtttatgctgctatttgtgaacagcttgttgagatgcataaaaccctctctgcccagcaagatcttgcaggaggcaggctggggaatctatactgtgacccattgatggcatctgggggtcacaaaattactgccagacagcggtggactccaacacctgtgcagcttcaaattcttgagcggatctttgatcaaggaaatggaactccaagcaagcaaaagattaaggagataacatctgaactcagtcagcatggacaaatttctgagacaaacgtctataattggttccaaaataggcgtgctcgatcaaaaagaaagcagttagttgcatcatccaacaatgctgaatcagaagtggagacagaagttgattcattaaatgaaaagaagaaaccagaaatatttcacgcccaacagaatcctcctagggctgaagatctgtgcttccaaagccctgagataagctctgaacttcatttcttgggggatgaccacctgacaggaaagatgggagtgccagggaactataatctttacgatcaagcagaggactatggcatggcaggctga

SEQ ID NO: 492 - protein, 248 aa, Populus trichocarpa
MDWDNNQENHQDSHQNQRECRNGINGTNVNVNGNGGTNMLYVKVMTDEQLETLRKQIAVYAAICEQLVEMHKTLSAQQDLAGGRLGNLYCDPLMASGGHKITARQRWTPTPVQLQILERIFDQGNGTPSKQKIKEITSELSQHGQISETNVYNWFQNRRARSKRKQLVASSNNAESEVETEVDSLNEKKKPEIFHAQQNPPRAEDLCFQSPEISSELHFLGDDHLTGKMGVPGNYNLYDQAEDYGMAG

SEQ ID NO: 493 - DNA, 546 bp, Triticum aestivum
  misc_feature (18)..(18): n is a, c, g, or t
  misc_feature (46)..(46): n is a, c, g, or t
  misc_feature (97)..(97): n is a, c, g, or t
atgcaaagacccagctcntacatggccaccagcatctccagctatntcatgccagctgctgcaggtatgagtcttggtaatctgtactgtgatcctntaatggttcatggaggccagaagatcacagcgaggcagcgatggacaccaacccagatgcagctgcagatcctcgagatcgttttcaaccaaggaaatggaacaccaagcaagcagaagataaaagacatcacagcggagctctcgcagcatggccagatctcggagaccaacgtctacaactggttccaaaacagacgtgcacgctcgaagcggaagcaagcagcttcttctctaccaaataacgctgaatccgaagccgagggggatgaggagtccctgaccgacaagaagcctagatcagatgggtcacagcagcagaacatggctgtgagagctcacaaccctgagaggatctcagagatgcaccgccacttcgacgcagcagagcgtgagcaggtccgtggtccaatgatgtatgggtccagcaacgacacctcaaggtcgtag

SEQ ID NO: 494 - protein, 181 aa, Triticum aestivum
  misc_feature (16)..(16): Xaa can be any naturally occurring amino acid
  misc_feature (33)..(33): Xaa can be any naturally occurring amino acid
MQRPSSYMATSISSYXMPAAAGMSLGNLYCDPXMVHGGQKITARQRWTPTQMQLQILEIVFNQGNGTPSKQKIKDITAELSQHGQISETNVYNWFQNRRARSKRKQAASSLPNNAESEAEGDEESLTDKKPRSDGSQQQNMAVRAHNPERISEMHRHFDAAEREQVRGPMMYGSSNDTSRS

SEQ ID NO: 495 - DNA, 822 bp, Zea mays
atggagtgggtggacaggaccaaggcctccgccgccgccgccgcagcggcggcggacgagagggctgggggagcggaagggctcgcgggatacgtcaaggtcatgaccgacgaacagatggaggtgctccgcaagcagatctccatctacgccaccatctgcgagcagcttgtcgagatgcaccgcgccctcaccgagcaccaggacaccattgcaggaattaggtttagtaatctgtactgtgatcctcaaattatccctggaggccacaagatcacagcaaggcaacgatggcaaccaacaccaatgcagctgcagatcttggagaacatctttgaccaaggcaatggaacaccaagcaagcagaggataaaggagataacggcagagctctcgcaccatggccaaatctcggagacaaatgtgtacaactggttccagaacagacgggcacggtcaaagcggaagcaggccgcttctttaccgaacaatgctgaatctgaagctgaggtggacgaggagtctctcaccgataagaagccgaagtcagatcggtcgctccaggacaacaaggctatgggcgctcacaacgctgacaggatatctgggatgcatcacttggacactgatcatgaccaaatcggtggcatgatgtatggatgcaatgacaacggcttgagatcgtctggcagttctggccagatgtccttctacgggaacatcatgccgaatccaagaatcgatcatttcccggggaaggtggagagctcccggagcttctcccatctccaacacggggaaggctttgacatgtttggatga

SEQ ID NO: 496 - protein, 273 aa, Zea mays
MEWVDRTKASAAAAAAAADERAGGAEGLAGYVKVMTDEQMEVLRKQISIYATICEQLVEMHRALTEHQDTIAGIRFSNLYCDPQIIPGGHKITARQRWQPTPMQLQILENIFDQGNGTPSKQRIKEITAELSHHGQISETNVYNWFQNRRARSKRKQAASLPNNAESEAEVDEESLTDKKPKSDRSLQDNKAMGAHNADRISGMHHLDTDHDQIGGMMYGCNDNGLRSSGSSGQMSFYGNIMPNPRIDHFPGKVESSRSFSHLQHGEGFDMFG

SEQ ID NO: 497 - DNA, 1542 bp, Brassica napus
atgatgatgttgcgcgtgtgtccgtcgtctctcttctatctccgaccacttcatctctccacttcctctgcgaaattccctttttgcccctctattcgccgagaattacgattagtcccttcccgatcttcttcttcttcgttccgtcggatggaatcttctccggcttcggaaacggattccttaggggaagatatgcagaatcaaactgatgaaggtgataagatcaaaaggaagctcgaagagtttaactgggaccactcctttgttaatgagctgcctggtgatccgagaagcgatgttatctcgcgtaaggtatttcatgcttgctattcaaaagtttccccgtcagtacaagtagatgatcctcagcttgtagcatggtctgattctgttgcggagctcttggatctacatcctaaagaatttgaaaggcttgatttccctctcctactctctggtgctaaacctttgcctggagcaatgccttatgctcaatgctacggaggccaccagtttggcaggtgggctggacagctaggcgacggtcgcgccattactctcggagaagttctgaactccaaaggcgaaagatgggagcttcagctcaaaggcgctggtagaactccttacagccgtttttcagatggcctcgcagtgcttcgtagtagcatcagggagttcctctgcagtgaagccatgcattgtcttggaatccccaccactcgcgccctttgtctcctcacgacaggtcaaggtgtcattcgcgacatgttttatgatggcaatgcgaaggaggaacctggtgctatcgtttgcagggtttctcagtcatttatccgcttcggctcgtaccaaatacatgcttctagaggaaaagaggaccttgagattgttgggaagctagcagactatgccattagacatcatttcccacgtatagagaagagcatgaacagaagtgatggcttatctttcaaaaccggtgatgatgatgatgattctgttttggatctaacatcaaacaagtatgcagcatgggttgttgaagttgcggagcgtacagctactttatttgcaagatggcaaggtgtaggattcacacatggagtgctcaacactgacaacatgagcattttgggtcaaaccattgactatggcccgtttgggttcttagatgcttttgatccaagttacaccccaaacacaacagacctccctggaagaagatactgttttgctaatcagcctgacatcggcttgtggaatattgctcaatttgctgaggctctggctgctgctcagctgataaatgaaaaggtggctaattacgccatggagaggtacggtgataagttcatggatgagtatgaagccataatgacaaagaagcttggtctttcgaagtacaacaaggagatgattagtgaacttctgaacaacatggctgttgataaagtcgattacacaaacttcttccggcttctttcgaatgtaaaagcagaccccaacacatctgatgatgagttattaaacccttga

SEQ ID NO: 498 - protein, 513 aa, Brassica napus
MMMLRVCPSSLFYLRPLHLSTSSAKFPFCPSIRRELRLVPSRSSSSSFRRMESSPASETDSLGEDMQNQTDEGDKIKRKLEEFNWDHSFVNELPGDPRSDVISRKVFHACYSKVSPSVQVDDPQLVAWSDSVAELLDLHPKEFERLDFPLLLSGAKPLPGAMPYAQCYGGHQFGRWAGQLGDGRAITLGEVLNSKGERWELQLKGAGRTPYSRFSDGLAVLRSSIREFLCSEAMHCLGIPTTRALCLLTTGQGVIRDMFYDGNAKEEPGAIVCRVSQSFIRFGSYQIHASRGKEDLEIVGKLADYAIRHHFPRIEKSMNRSDGLSFKTGDDDDDSVLDLTSNKYAAWVVEVAERTATLFARWQGVGFTHGVLNTDNMSILGQTIDYGPFGFLDAFDPSYTPNTTDLPGRRYCFANQPDIGLWNIAQFAEALAAAQLINEKVANYAMERYGDKFMDEYEAIMTKKLGLSKYNKEMISELLNNMAVDKVDYTNFFRLLSNVKADPNTSDDELLNP

SEQ ID NO: 499 - DNA, 1773 bp, Glycine max
atgagatatgagatgggagtctccattctcacccgtttccatttctctctccctctcccacgcgccaccgccagaaagaggattttccatttctgccctccgattgcatgccgctcatccatggatcagtcttctggcctgaatctggaagatctgaaatgggaccattccttcgtcagagaattgcccggcgatccccgccgcgactcctttccccgtgaggttctgcatgcttgttacacccaagtctctccttctgttcaagtacacaatccccaacttgtagccttctcccaaccagttgccgacctacttgatctcgaccataaagaatttcagaggccagattttccccttttcttctctggtgccacacctttagttggagcgttgccttatgctcagtgctatggcgggcatcaatttggtatgtgggctgggcagctgggtgatggcagggcaatgactctaggggagatactgaattctaactctgaaaggtgggaacttcaacttaaaggagctggcaagactccttacagtcgctttgccgatggccttgccgtcctccgcagcagcgtcagggagttcctttgcagtgaggcaatgcaccaccttggtataccaacaactcgtgcactttctcttgttaccaccggcaacctcgtcacccgtgacatgttttatgacggcaatccaaaggaagaacctggcgcaattgtttgcagagttgcccaatcttttctgcggtttgggtcataccaaatacatgcctccagaagtgatgaggacctaggccttgttcgtgttttggcagactatgctatcaggcaccactttcctcatattcaaaatatgagcaagagtgatagcttatctttctgcactggtgatgaagatcattctgttgtagatctcacttcaaataagtatgcagcatgggtggtggagattgctgagcgtactgcttccctgattgctagatggcagggggttggtttcactcatggcgtgctgaacacggataacatgagcattttgggtcttacaatagattatggcccatttggatttttggatgcttttgatcctaaatttaccccaaatactacagatcttccaggtcgaagatactgttttgcaaaccagcctgacattggtttgtggaatattgcacagttcacaacaacactacaagctgctcatttaataaatgaaaaagaggccaactatgctatggaaagatatggaacgagatttatggatgattatcaggttacaatgaccaaaaagcttggcctccctaagtataataagcagatgattaataaacttcttagcaatatggctgttgacaaagttgattacacaaacttctttcgtacgctttcaaatgttaaagcagacataaacattccagatgatgagctgttagtcccactaaagtctgtactgttagatattggtaaagagcgtaaggaagcatggaccagttggttgaaagcttatatacatgaggtctctaccagtgggatacctgatgacgaaaggaagatctcgatggattcagtgaatcctaaatatatactgaggaactatctctgccagactgcaattgatgctgcagaaataggtgattttggagaggttcgcagcctgctcaaattagtggagcatccgtatgatgagcaaccaggaatggaaaaatatgctcgcttgcccccagcttgggcatatcgaccaggtgtatgcatgctttcttgttcttcatga

SEQ ID NO: 500 - protein, 590 aa, Glycine max
MRYEMGVSILTRFHFSLPLPRATARKRIFHFCPPIACRSSMDQSSGLNLEDLKWDHSFVRELPGDPRRDSFPREVLHACYTQVSPSVQVHNPQLVAFSQPVADLLDLDHKEFQRPDFPLFFSGATPLVGALPYAQCYGGHQFGMWAGQLGDGRAMTLGEILNSNSERWELQLKGAGKTPYSRFADGLAVLRSSVREFLCSEAMHHLGIPTTRALSLVTTGNLVTRDMFYDGNPKEEPGAIVCRVAQSFLRFGSYQIHASRSDEDLGLVRVLADYAIRHHFPHIQNMSKSDSLSFCTGDEDHSVVDLTSNKYAAWVVEIAERTASLIARWQGVGFTHGVLNTDNMSILGLTIDYGPFGFLDAFDPKFTPNTTDLPGRRYCFANQPDIGLWNIAQFTTTLQAAHLINEKEANYAMERYGTRFMDDYQVTMTKKLGLPKYNKQMINKLLSNMAVDKVDYTNFFRTLSNVKADINIPDDELLVPLKSVLLDIGKERKEAWTSWLKAYIHEVSTSGIPDDERKISMDSVNPKYILRNYLCQTAIDAAEIGDFGEVRSLLKLVEHPYDEQPGMEKYARLPPAWAYRPGVCMLSCSS

SEQ ID NO: 501 - DNA, 1935 bp, Gossypium hirsutum
atgagatttcatttctctccaaagacaccgctcttctcactctcttcttcctctatcacttccctttgcctccgtcctttccttccttctgccactaaatcccctttttacccttccctcgcatgccacgtgtccaccggcggcaaccttcgcatggactcgacttcaccggatccctcctcttcctcctccgtctccgttgactccgtcgccgacggtttgaaaaaccaaagcttaagagaacatgatatcagtaataataataatatgaacaatgaaaataagaagaataatggtaaattgagccttgaagatcttaattgggaccattcattcgttagagaactgcctggtgaccctataagcgattcaattccacgtcaggttttccatgcatgttatacaaaagttttgccgtcagctgaagtagagaatcctaagcttgttgcctggtcagattcagtggctgatttgcttgatttggatcccaaagaatttgaaagaccagattttccccttaaattttctggggcctctcccttggcaggagcggtgccatatgctcaatgttatggaggacatcagtttggcacatgggctggtcaactgggtgacggccgtgccattactcttggggagataatcaattcgaaattagaaaggtgggaactgcagcttaaaggagctgggaagacgccatacagtcgatttgcggatgggcttgcagttttacggagtagcatccgtgaatatctttgcagtgaagcaatgcattttctaggaattccaactactcgcgctctttgtcttgtgactacaggaaaatttgtaactcgggacatgttttatgatggcaatccaaaggatgagcctggtgcagttgtttgcagagtttcccagtcctttctgcggtttggttcattccaaatacatgcttcaaggggaggagaggaccttggtattgtacgttcgttggcagactatgccatcagacatcatttccctcacattgagaacatgagcaaaagtgagagcttgtcttttagcactggtgacaatgatcaatcagttgtggatttgacttcaaacaagtatgcagcatggacagtggagattgctgagcgtactgcctctttggttgctagatggcagggagttggctttactcatggtgtgctgaacacggacaacatgagtattttaggtctcaccattgattatggtccttttggatttttggatgcttttgatccgagttacacaccaaatgttacagatcttccagggagaagatactgttttgcaaatcagcctgatattggcttatggaatattgcacaatttgcctcaactttgatgactgccaacttgataagtgatcaagaagcaaattatgcgatggaaaggtatgggacaaaatttatggacgattatcaagcaatactgagccaaaagcttggcctccaaaaatacaataaacagcttgtcaataaacttcttagtaatttggctgttgataaagtggattacacgaacttctttcgggcactttccaatatcaaagcagatcctagcattccaggtgatgagttgttggtgccattgaaagctgttctgctagacatgggcaaggaacgcaaggaggcgtggactagttgggtacaaacctacattcaagagctggttgcgagtggcgtctcagatgaggagaggaaagcttcaatgaactcagttaaccctaaatatgttctcaggaactacttatgtcagagcgctatcgatgcagctgaaatgggtgacttggaagaagtccgaaggctccttaaagtaatggagcgaccatatgatgaacaaccgggaatggaaaaatatgctcatttgcctccagcatgggcttatcggcctggtgtgtgcatgctatcctgttcgtcatga

SEQ ID NO: 502 - protein, 644 aa, Gossypium hirsutum
MRFHFSPKTPLFSLSSSSITSLCLRPFLPSATKSPFYPSLACHVSTGGNLRMDSTSPDPSSSSSVSVDSVADGLKNQSLREHDISNNNNMNNENKKNNGKLSLEDLNWDHSFVRELPGDPISDSIPRQVFHACYTKVLPSAEVENPKLVAWSDSVADLLDLDPKEFERPDFPLKFSGASPLAGAVPYAQCYGGHQFGTWAGQLGDGRAITLGEIINSKLERWELQLKGAGKTPYSRFADGLAVLRSSIREYLCSEAMHFLGIPTTRALCLVTTGKFVTRDMFYDGNPKDEPGAVVCRVSQSFLRFGSFQIHASRGGEDLGIVRSLADYAIRHHFPHIENMSKSESLSFSTGDNDQSVVDLTSNKYAAWTVEIAERTASLVARWQGVGFTHGVLNTDNMSILGLTIDYGPFGFLDAFDPSYTPNVTDLPGRRYCFANQPDIGLWNIAQFASTLMTANLISDQEANYAMERYGTKFMDDYQAILSQKLGLQKYNKQLVNKLLSNLAVDKVDYTNFFRALSNIKADPSIPGDELLVPLKAVLLDMGKERKEAWTSWVQTYIQELVASGVSDEERKASMNSVNPKYVLRNYLCQSAIDAAEMGDLEEVRRLLKVMERPYDEQPGMEKYAHLPPAWAYRPGVCMLSCSS

SEQ ID NO: 503 - DNA, 2367 bp, Medicago truncatula
atgatggtactattaactactagtagtatttgtttccctcgtctgttgtcgttgtatccaaactcactcatccgacgcggcggtggcataaggaaattccatttataccctgttagatgctgcagaatgatgatggattcaacagagaagggattgtcagcaccgttgcttgactctgtaactcaagaatttaagaatcaaagccttattcagaagaagaaacgcgaacttgaagatctgaattgggataattcctttgttagagacttaccctctgatccaagaaccgatccctttccaagagaggtattgcatgcttgctatacaaaagtatcaccatcagtttcagtagatgatccacaactcgttgtatggtctgaatccgttgccgaactacttgacttagataataacgaatttcaaagacctgattttccccttttcttctctggtgcatcaccttttgttggtgccttcccttatgctcaatgctatggtggacatcaatttggtatgtgggctggccagttgggtgatggtagagcaatcactcttggggagatactcaattctaactctcaaaggtgggagctacagcttaaaggtgctgggaagactccttacagtcgctttgccgatggtcttgctgtgctacgtagcagcgtcagagagttcctttgcagtgaagcaatgcatcatctcgggattccaacaacccgtgctctttctcttgtcaccactggaaagttggttactcgagatatgttctacgatgggaatccaaaggaagaacagggtgcaatcgtttgtagagttgctcaatcttttctgcgttttgggtcataccaactacatgcctccagaggtagtaatgaggacctggagattgttcgtgttttggcagactatgctattaaacaccactttcctcatattgaaaacatgagtaagagtgagagcttatctttcagcacgggtgatgaagatcattcagtcgtggatcttacatcaaacaagtatgcagcatgggcggtagagattgctgagcgtactgcttccatgattgctagatggcagggggttggtttcactcatggtgtgatgaacacggataacatgagcattttgggtcttactattgattatggtccatttgggtttttggatgcttttgatcctaaatttaccccaaataccacagaccttccaggtagaagatactgttttgcaaaccagcctgacattggtttgtggaatcttgcacagtttacaacaacactgtcagctgctcatttgataaatgacaaagaggctaactatgctttggaaagatatggaacaaaatttatggatgattatcaagatataatgaccaaaaagcttggcctccctaagtataataaacagctgattggtaaacttcttactaatatggctgttgacaaagttgattatacaaacttctttcgcacactctcaaatattaaagcggacacaagcattccagatgatgaattgcctatatggtccacatgggcggtagagattgctgagcgtactgcttccatgattgctagatggcagggggttggtttcactcatggtgtgatgaacacggataacatgagcattttgggtcttactattgattatggtccatttgggtttttggatgcttttgatcctaaatttaccccaaataccacagaccttccaggtagaagatactgttttgcaaaccagcctgacattggtttgtggaatcttgcacagtttacaacaacactgtcagctgctcatttgataaatgacaaagaggctaactatgctttggaaagatatggaacaaaatttatggatgattatcaagatataatgaccaaaaagcttggcctccctaagtataataaacagctgattggtaaacttcttactaatatggctgttgacaaagttgattatacaaacttctttcgcacactctcaaatattaaagcggacacaagcattccagatgatgaattgttagtgccattaaagtcagtgctattagatattggtcaagagcgtaaagaagcgtggacaagttggttgaaaacctatatacacgagctctctacaagtggcatttctgatgatcagaggaagacctccatgaatatggtaaatcctaaatatattctcaggaactatctttgccagactgcaattgatgctgcagaaatcggtgattttggagaagttcgtaggttacttaaattagtggaacatccttttgatgagcagccaggaatggaaaagtatgctcgcttacccccagcatgggcatatcgaccaggtgtatgcatgctttcttgttcctcatga

SEQ ID NO: 504 - protein, 788 aa, Medicago truncatula
MMVLLTTSSICFPRLLSLYPNSLIRRGGGIRKFHLYPVRCCRMMMDSTEKGLSAPLLDSVTQEFKNQSLIQKKKRELEDLNWDNSFVRDLPSDPRTDPFPREVLHACYTKVSPSVSVDDPQLVVWSESVAELLDLDNNEFQRPDFPLFFSGASPFVGAFPYAQCYGGHQFGMWAGQLGDGRAITLGEILNSNSQRWELQLKGAGKTPYSRFADGLAVLRSSVREFLCSEAMHHLGIPTTRALSLVTTGKLVTRDMFYDGNPKEEQGAIVCRVAQSFLRFGSYQLHASRGSNEDLEIVRVLADYAIKHHFPHIENMSKSESLSFSTGDEDHSVVDLTSNKYAAWAVEIAERTASMIARWQGVGFTHGVMNTDNMSILGLTIDYGPFGFLDAFDPKFTPNTTDLPGRRYCFANQPDIGLWNLAQFTTTLSAAHLINDKEANYALERYGTKFMDDYQDIMTKKLGLPKYNKQLIGKLLTNMAVDKVDYTNFFRTLSNIKADTSIPDDELPIWSTWAVEIAERTASMIARWQGVGFTHGVMNTDNMSILGLTIDYGPFGFLDAFDPKFTPNTTDLPGRRYCFANQPDIGLWNLAQFTTTLSAAHLINDKEANYALERYGTKFMDDYQDIMTKKLGLPKYNKQLIGKLLTNMAVDKVDYTNFFRTLSNIKADTSIPDDELLVPLKSVLLDIGQERKEAWTSWLKTYIHELSTSGISDDQRKTSMNMVNPKYILRNYLCQTAIDAAEIGDFGEVRRLLKLVEHPFDEQPGMEKYARLPPAWAYRPGVCMLSCSS

SEQ ID NO: 505 - DNA, 1881 bp, Oryza sativa
atgcccccacacctctcctcctccctcttctcctcctcccctctccccaccaccctcctctcctccctcacccgccgcgcccgcgccctcctccccctccccctccccctccccgccgcctccacccgccgccgcctccctctccgccgcggcccgctgctgacgcgtggcatcatggcctccgccgccgcagaggcaccggccccgtcgccctcgcccaccgccgccgcgaacagccgaccgcggcgggtgctggaggagctctcctgggacgactccttcgtccgcgagctccccggcgacccccgatccgacgccatcccccgcgaggtgcttcacgcttgttacacaaaggtgtcaccctcagcgcccgtggacaaccctaagctggtggcgtggtcccagtccgtggctgacatcctcgatctggatcacaaagagtttgaaagacctgattttcctcagctgttctcaggagcaaatcctttggttgggagttcaccttatgcccagtgctatggtggacaccagtttggttcatgggctggtcagttgggcgacggacgagcaataactcttggagaggttatcaactctcgaggtgagagatgggagttgcagctcaagggctgtggaaagactccatacagccgatttgcagatggccttgctgtcctccgcagcagcattcgtgaattcctatgcagtgaagctatgcatggcctaggcatccctacaactcgtgctctttgtctagttgaaactggcaaatctgttgttcgagatatgttctatgatggcaattcaaaggaggaaccaggtgccattgtatgccgtgtagcaccatcctttttgcgttttggttcatatcagatacatgctacaagggacaaagaggaccttgaaattgttcgtcatttggcagactacacaatacgtcatcactacccacatctcgaaaatattaaaaagagtgaaggtttatcttttgaagcagctataggggactctccagcgatagatcttacttcgaacaaatatgcagcctgggcagttgaggttgcagagcgcactgctttcttgatagcaaggtggcaaggtgttggttttacccatggtgtgctcaacacggataatatgagtgtattaggactaactattgactatggaccctttggctttttggatgcttttgatcctagctatactccaaatacaacagacctccctgggaagagatactgttttgcaaatcaacctgatgttggcttgtggaatattgctcagtttacctcaccattgacagctgccgaacttatcagcaaagatgaggcaaattatgtgatggagaggtacgggacaaagtttatggatgagtatcaatccataatgaccaggaaacttggtctacccaagtataataagcagctaataggcaagctgcttaacaacctggctgttgataaggtcgattatacaaactttttccgtcttctttcaaatgtcaaagcagaccataacattccagagaaggagctacttgttccacttaaagctgcactcctagatattggaccagaaagaaaggaagcatggattagttgggtacaaacttacattgaagagttggtttcaagtggcgttcctgacgaagaaaggaaagctgccatgaactctgttaatccaaagtatgttcttcggaactatctctgccagactgcaattgacgcagctgagcaaggtgattatgatgaagttcgtcggttattgaaagttatggaacatccatatgatgagcagccaggaatggagaaatatgcccggttgccaccagcctgggcatacaggccaggagtgtgcatgctgtcctgctcatcatga

SEQ ID NO: 506 - protein, 626 aa, Oryza sativa
MPPHLSSSLFSSSPLPTTLLSSLTRRARALLPLPLPLPAASTRRRLPLRRGPLLTRGIMASAAAEAPAPSPSPTAAANSRPRRVLEELSWDDSFVRELPGDPRSDAIPREVLHACYTKVSPSAPVDNPKLVAWSQSVADILDLDHKEFERPDFPQLFSGANPLVGSSPYAQCYGGHQFGSWAGQLGDGRAITLGEVINSRGERWELQLKGCGKTPYSRFADGLAVLRSSIREFLCSEAMHGLGIPTTRALCLVETGKSVVRDMFYDGNSKEEPGAIVCRVAPSFLRFGSYQIHATRDKEDLEIVRHLADYTIRHHYPHLENIKKSEGLSFEAAIGDSPAIDLTSNKYAAWAVEVAERTAFLIARWQGVGFTHGVLNTDNMSVLGLTIDYGPFGFLDAFDPSYTPNTTDLPGKRYCFANQPDVGLWNIAQFTSPLTAAELISKDEANYVMERYGTKFMDEYQSIMTRKLGLPKYNKQLIGKLLNNLAVDKVDYTNFFRLLSNVKADHNIPEKELLVPLKAALLDIGPERKEAWISWVQTYIEELVSSGVPDEERKAAMNSVNPKYVLRNYLCQTAIDAAEQGDYDEVRRLLKVMEHPYDEQPGMEKYARLPPAWAYRPGVCMLSCSS

SEQ ID NO: 507 - DNA, 2109 bp, Physcomitrella patens
atggcatcttcattccgagcagcctcgcactgcatccccgtctctgctcccgcttctgcgtttccaacgaaccccttcttgttgcgttcggcgcccatttggtctggtttcggtggccttagggttggcgttgagaatggtgggagtgaggcggtgcatcgccctccacatgctggatgtggattaggcgtgagggctggagctggtcgagtcgatagaggaggaggccgtgaagttgtgtatggtttgttaggtcgtcgtgcgggtgagagcaggaggggaaaagctggtgcagcgttgctgcgggatttcggttcgtcgcgggggcgtgtcttgactgctgccatgacggataatatgaagaatttgaacctggatgacgacaagtctgtcaatggtgacgtcgccgaaaaggtggataagtctgaagaaatcggagcttcaggcagcttgggaaggaaaaagttggaggacttaatctgggatcattcatttgtgcgagaacttcctggcgataaacgaagtgatggtccaacacgtcaggtgctacacgcatgctactcgaaggtcactccttcagtgcgcgtaaaaaacccggagctggtttcttggtcacggcatgttgctgatctgctggatcttgattataaagaatttgaacgaccagacttccctcttcttttcactggagcttctcaattgaagggcggcttagcttatgcacagtgctacggagggcatcaatttggtgtgtgggctggacagttgggagatggacgtgcaattacgttgggagaaatattgaactcaaaagggcagaggtgggagttgcagttgaaaggagccggtaaaacaccatacagccgtactgctgatgggcttgcagtacttagaagcagcgttcgtgagtacctttgcagtgaagctatgtatcatttgggagttccaacgacacgagctttgtccttagtgactactggagaaggggttttgcgcgacatgttctatgacggcaatgtcaaaatggagccaggtgccgtcgtttgccgtgtatccccgtcattcattcgttttgggtctttccaaattcatgcagcccgggataaggccgacctcccaattgtcaaacaattggctgattatacaattcatcatcattatcctgactttgaggatttgccattcgaaaggcaggggcaagacggttctgaatctcaaaaaggcgagaacaatgctcctcaaattgatacatcgaaaaataaatattcagcatggttcactgagattgcagagcggactgcattgatgattgcaaaatggcaagcagttggattcacacatggagttatgaatactgataatatgagcatattgggtttaactattgactacggtccttttggatttttggacgcttttgatcccaaatatacgccgaatacaacagatcttcctggtcgtcgttatgggtttgccaatcaaccggatattggtctgtggaatgtgatgcagctggcaaacacactatacactgcagaactcattactgcagatgaagcccaatatgtaacaattcaaatatatgctgataaattcatgtttttatatcagcaacacatgagtaacaaaattggtctgaaaacatataacaaagatctgcttagcaagcttctgaacaatatggccttcgacaaagtggactacacaaactttttcaggtcgttcagtaatctgaaagctactccagaaacctcagacgatgacttgattgcaccgctgaaaaatgcactccttgacctgagcaaggaaaggagaaaagtgtggctcgactggttgcaccagtacgtcaagaacgtggttgatgagggtgtatcagaggcagataggaaagccttgatgaattcagtcaacccaagatacgtcctgcgtaattatatgttacagagtgctattgatatggcagaacaaggggacttttcggaagtcgagaacttgctgaaactcatcgagcggccttacgacgatcaacctggaatggagaaatacgctaggcttccgcctgcctgggcttatcgtccaggggtttgcatgttatcttgctcgtcttga

SEQ ID NO: 508 - protein, 702 aa, Physcomitrella patens
MASSFRAASHCIPVSAPASAFPTNPFLLRSAPIWSGFGGLRVGVENGGSEAVHRPPHAGCGLGVRAGAGRVDRGGGREVVYGLLGRRAGESRRGKAGAALLRDFGSSRGRVLTAAMTDNMKNLNLDDDKSVNGDVAEKVDKSEEIGASGSLGRKKLEDLIWDHSFVRELPGDKRSDGPTRQVLHACYSKVTPSVRVKNPELVSWSRHVADLLDLDYKEFERPDFPLLFTGASQLKGGLAYAQCYGGHQFGVWAGQLGDGRAITLGEILNSKGQRWELQLKGAGKTPYSRTADGLAVLRSSVREYLCSEAMYHLGVPTTRALSLVTTGEGVLRDMFYDGNVKMEPGAVVCRVSPSFIRFGSFQIHAARDKADLPIVKQLADYTIHHHYPDFEDLPFERQGQDGSESQKGENNAPQIDTSKNKYSAWFTEIAERTALMIAKWQAVGFTHGVMNTDNMSILGLTIDYGPFGFLDAFDPKYTPNTTDLPGRRYGFANQPDIGLWNVMQLANTLYTAELITADEAQYVTIQIYADKFMFLYQQHMSNKIGLKTYNKDLLSKLLNNMAFDKVDYTNFFRSFSNLKATPETSDDDLIAPLKNALLDLSKERRKVWLDWLHQYVKNVVDEGVSEADRKALMNSVNPRYVLRNYMLQSAIDMAEQGDFSEVENLLKLIERPYDDQPGMEKYARLPPAWAYRPGVCMLSCSS

SEQ ID NO: 509 - DNA, 1941 bp, Populus trichocarpa
atgccaccactgctttctcattcctcctcttcactctccctcctccgtcccttcctccctatcaaattccctttctaccctccccctttcgtcaaatcccaattctgccctctatcacctcctgctcacctcttcaaaccctccctgtcacgccacgtcagcacgagctccttcccttctagcagaggtagaggtagtagtgtttccatggagtcatcctcaccagaaccaactgtgtcactcgactccgtgacgcaggatttaaagaatcaaactttaggtcctgatgatgttagtaaggctaaattgaagcttgaagatctcaattgggaccattcttttgttagagcattgcccggggatccaagggctgatacaattccacgtcaggtgatgcatgcttgctatacgaaagtgttaccatctgctgaagtggagaaccctgagcttgttgcttggtctgattctgttgctgatttatttgatttggatcctaaagaatttgaaaggccagattttccccttttgttttcaggggcttctcctttggttggagcgttgccatatgctcagtgctatggaggacatcaatttgggatgtgggcaggtcagctgggtgatggtagggcaataacacttggggaggttgtaaattcaaagtctgaaaggtgggaactgcaacttaaaggttccgggaggactccgtatagccgttttgcagatggccttgcggttttgcgtagcagcattagggaatttctttgcagtgaagcaatgcactgtctaggaatcccgacaactcgtgcactttctctcgtgacaacaggaaaatatgttacccgtgacatgttttacgatggcaatgcaaaggaagaacctggtgctattgtttgccgagttgcaccatcctttcttcggtttggttcgtaccaaatacatgcctctagagggaaagaggaccttgaaattgttcgtgctttggcagattatgccatcagacatcattttcctcatattgagaacatgaataaaagcgagagcttatcttttagtacaggtgatgaagatcattcagttgtggatctgacctcaaacaagtatgcagcttggacagtggagattgctgaacggactgcttctatgatcgcaagctggcaaggggttggctttacacatggagtaatgaacactgacaacatgagtatactgggtctcaccattgattatggtccctttggattcctggatgcctttgatcctagtttcactccaaacaccacggatcttccaggaagaagatactgttttgcaaatcagcctgatattggtttatggaatattgcacagttcacagctaccctttcaactgccaagttgattagcgataaggaggcagattatgccatggaaagatatggaaacaaattcatggatgagtatcaagctatgatgactagaaaacttggccttccaaagtacaataaacaattgatcagcaaactccttaataatatggctgtggataaagttgattacacaaatttcttccggttgctttccaatgttaaagcagacccaaaaattccggaagatgagttgttagttcccctgaaggctgttcttttagatattggacaggagcgtaaagaggcatggatgagctgggtgcaatcctatgtgcatgagctggctgctagtgggatctcagatgagcagaggaaggcccaaatgaattcagtaaaccccaagtatgttctccgaaactacttgtgccagactgccattgatgcagctgaacaaggtgattacacagaggtcaggaggctccttaaattaatggagcggccgtatgatgagcagcctggaatggaaaaatatgctcgccttccaccagcctgggcgtatcggcctggtgtttgcatgctttcatgctcttcatga

SEQ ID NO: 510 - protein, 646 aa, Populus trichocarpa
MPPLLSHSSSSLSLLRPFLPIKFPFYPPPFVKSQFCPLSPPAHLFKPSLSRHVSTSSFPSSRGRGSSVSMESSSPEPTVSLDSVTQDLKNQTLGPDDVSKAKLKLEDLNWDHSFVRALPGDPRADTIPRQVMHACYTKVLPSAEVENPELVAWSDSVADLFDLDPKEFERPDFPLLFSGASPLVGALPYAQCYGGHQFGMWAGQLGDGRAITLGEVVNSKSERWELQLKGSGRTPYSRFADGLAVLRSSIREFLCSEAMHCLGIPTTRALSLVTTGKYVTRDMFYDGNAKEEPGAIVCRVAPSFLRFGSYQIHASRGKEDLEIVRALADYAIRHHFPHIENMNKSESLSFSTGDEDHSVVDLTSNKYAAWTVEIAERTASMIASWQGVGFTHGVMNTDNMSILGLTIDYGPFGFLDAFDPSFTPNTTDLPGRRYCFANQPDIGLWNIAQFTATLSTAKLISDKEADYAMERYGNKFMDEYQAMMTRKLGLPKYNKQLISKLLNNMAVDKVDYTNFFRLLSNVKADPKIPEDELLVPLKAVLLDIGQERKEAWMSWVQSYVHELAASGISDEQRKAQMNSVNPKYVLRNYLCQTAIDAAEQGDYTEVRRLLKLMERPYDEQPGMEKYARLPPAWAYRPGVCMLSCSS

SEQ ID NO: 511 - DNA, 546 bp, Triticum aestivum
  misc_feature (470)..(470): n is a, c, g, or t
  misc_feature (479)..(479): n is a, c, g, or t
  misc_feature (485)..(485): n is a, c, g, or t
atgcccaagtgttacggtggacaccagtttggttcatgggctggtcagttgggggatggacgagcaataactctcggagaggttctcaattctcgaggtgagaggtgggagttgcagctcaagggtgctggaaagactccttacagccgatttgcagatggcctcgctgtcctgcgcagaagcatccgtgaattcttatgcagtgaagctatgcatggtctaggcattcctacaactcgtgctctttgtctagttgaaactggcaaatctgttgtgcgagatatgttctatgatggtaatgcaaaagaggagccaggtgcaattgtgtgccgtgtagcaccatcgtttttacgttttggttcataccagttacatactacaaggggcaaagaggaccttgaaattgttcgtcgtttggcagactacacaatacgtcatcactacccacatcttgaaaatattaaaaaaantgaagttancttttngaggcagctatgggagacatccaacataatcttacttccaacaatatcgctgggaatttag

SEQ ID NO: 512 - protein, 181 aa, Triticum aestivum
  misc_feature (157)..(157): Xaa can be any naturally occurring amino acid
  misc_feature (160)..(160): Xaa can be any naturally occurring amino acid
  misc_feature (162)..(162): Xaa can be any naturally occurring amino acid
MPKCYGGHQFGSWAGQLGDGRAITLGEVLNSRGERWELQLKGAGKTPYSRFADGLAVLRRSIREFLCSEAMHGLGIPTTRALCLVETGKSVVRDMFYDGNAKEEPGAIVCRVAPSFLRFGSYQLHTTRGKEDLEIVRRLADYTIRHHYPHLENIKKXEVXFXRQLWETSNIILLPTISLGI

SEQ ID NO: 513 - DNA, 1893 bp, Zea mays
atgccgccccagttccccaccgcccgcctcctcctccctagtcacaggctgctcccgctcctctcccctctcccctccgcgtccctgtcccctgctcctcgcaccctccgcctcccgccgccgcagcttcttcaccgagtcgcccgccgccgcccgctgctgcgcggcatggcctccgccgccgcccccgggtcacacgccgccgcggaagcgccccccgtcgacgtggggggagggggcgctggcgccccgcggcggctcgtcctggaggagctaccctgggaccattccttcgtccgcgagctgcctggcgacccgcgatcggacactatcccgcgggaggtcctgcacgcctgttactccagggtgtctccctctgccaaagtggacaaccccaagctggttgcgtggtctgattccgtggccgatctactcgatctggatcacaaagagtttgaaagacctgatttccctcagtttttctcaggagcaactccactagtggggagtttgccctacgcacagtgctatggaggacatcagtttggtgtatgggctggtcagttgggggatggaagagcgatagctcttggagaggttgtcaactctcgaggtgagagatgggagttgcagctcaaaggttgtggaaagactccatacagcagatttgctgatggtcttgctgtcctacgcagcagcatccgtgaattcttatgcagcgaagccatgcacggcctaggcattcctacaactcgtgctctttgtctagttgaaactggaaaatcagttgtccgagatatgttctatgatggcaatgcaaaggaagaacctggtgcaatagtttgtcgtgtagcaccgtcttttttacgttttggttcgtatcagatacacgcttcaaggggcaaagaggacattgagattgttcgtcgtttggcagactacacgatacatcatcactttccacatcttgaaaatatgaaaaagagtgaaggtttgtcattcgagacagctataggagattccccaacaatagatctcacatcaaacaaatatgcagcttgggcagttgaggtggcggagaggactgcttacttgatagctagatggcaaggtgttggcttcacccatggtgtacttaacactgacaacatgagtgtgctgggcctaactattgattatggaccatttggatttctcgatgcatttgatcctagctatactccaaatactactgatcttcctgggaagaggtactgttttgcaaatcaacctgatgttggcttgtggaatattgctcagttcactggaccactgtcctctgctgaacttatcagccaagatgaggcaaattatgtgatggagaggtatgggacaaagttcatggatgagtaccaatctatcatgaccaaaaaactgggcttaactaagtataataagcagctaattagtaagctgcttagcaacatggcagttgacaaggttgactataccaacttcttccgtcttctttcgaatgtcaatgcggatcctggtattccggagaatgagctgcttgtcccactgaaggctgctctcctagatattgggaaagaaaggaaggaagcatggattagttgggtacagacttatattgaagagctggtggagagcggcgttcctgatgaagaaaggaaagccgcgatgaactctgttaatccaaagtatattctccgcaactatctctgccagtctgctatcgacgtagctgagcaaggcgattacgaggaggttcgccgggtgcttagggtaatgcataatccgtatgacgagcagccgggaatggagaaatatgcacggttgccaccagcttgggcatacagacctggagtgtgcatgctgtcctgctcctcgtga

SEQ ID NO: 514 - protein, 630 aa, Zea mays
MPPQFPTARLLLPSHRLLPLLSPLPSASLSPAPRTLRLPPPQLLHRVARRRPLLRGMASAAAPGSHAAAEAPPVDVGGGGAGAPRRLVLEELPWDHSFVRELPGDPRSDTIPREVLHACYSRVSPSAKVDNPKLVAWSDSVADLLDLDHKEFERPDFPQFFSGATPLVGSLPYAQCYGGHQFGVWAGQLGDGRAIALGEVVNSRGERWELQLKGCGKTPYSRFADGLAVLRSSIREFLCSEAMHGLGIPTTRALCLVETGKSVVRDMFYDGNAKEEPGAIVCRVAPSFLRFGSYQIHASRGKEDIEIVRRLADYTIHHHFPHLENMKKSEGLSFETAIGDSPTIDLTSNKYAAWAVEVAERTAYLIARWQGVGFTHGVLNTDNMSVLGLTIDYGPFGFLDAFDPSYTPNTTDLPGKRYCFANQPDVGLWNIAQFTGPLSSAELISQDEANYVMERYGTKFMDEYQSIMTKKLGLTKYNKQLISKLLSNMAVDKVDYTNFFRLLSNVNADPGIPENELLVPLKAALLDIGKERKEAWISWVQTYIEELVESGVPDEERKAAMNSVNPKYILRNYLCQSAIDVAEQGDYEEVRRVLRVMHNPYDEQPGMEKYARLPPAWAYRPGVCMLSCSS

SEQ ID NO: 515 - DNA, 1605 bp, Arabidopsis thaliana
atgtctggtaacaacaacaatccacaaaagcctcaaggctctgcgcctttgccttttgggaatcctgggatggcctctgcatctgttcctggaaaccaaggttttgctcagtctcatatggcagctaactttcaagctcagtttcagttctctcaagctcaggccctagcccatgctcaagcacagtctaaagttcaagcacaactgcaagctcagttacaagctcaaggcatgacgatgaaccaagcacaaggttctccggggattggtggcttgggtccttcttctccttctttgacgactcctggaagtttaaacatgaagagattccagcagaaaccgccgatgcgacctcctggtgctcctgcgagtaacaacactatctccccaatgagaacaatggagttaactcctgctgctcggaaaaagaaacaaaagcttccagaaaagtcattgcaggagcgggtggctgcaatcttgccagagtctgccttatacacacaacttctggagtttgagtctcgggttgatgctgcgttaactagaaagaaagttgacatccaggaagcccttaaaaaccctccctgcatacagaagactcttaggatctacgttttcaactcgtttgctaaccaaaacaacacgatccctgggaatcctaatgctgacccgccaacatggactcttaaaattattggtaggatactggaagatggggtggatcccgaccagccagggtttgttcagaaagcaaacccattgcatcccaaattctcgtctttcttcaaaagggttacagtttccctggatcagaggctgtatcctgagaacccattgatcatatgggagaatgctcgatcacctgctcctcaggaaggctttgagataaagaggaaagggaatcaggagtttgctgctagtatacggttggagatgaactacgtccctgaaaagttcaagctttctactgcattgatggatgttctcgggattgaggttgaaacccgcccaagaatcatcgctgcaatttggcattacgttaaggcgaggaaactgcagaacccaaatgacccctctttcttcaactgtgatgctgcacttcagaaagtttttggagaagaaaagttgaaattcactatggtctctcagaaaatatctcatcacttgtcgcctccaccacctattcacttagaacacaaaatcaagctctcaggaaataatccggccgtatcagcatgttacgatgtgctagtggatgtacccttcccgatccaaagagatctgaacaatttgctagccaacgcagagaagaacaaagagattgaggcttgtgatgaagcaatatgtgcagccataaggaaaatccatgagcataggaggaggcgggcatttttcttggggttcagccaatcgccagttgaattcataaacgccctgatcgaatctcagagcaaggatctaaaggtcgttgcgggagaagccagtcgaaatgctgagagagaacgtcgatcagacttcttcaaccaaccttgggtcgaagatgcagttatacgttacttgaaccggaggccagcagctgggaacgatgggccagggagttggtga

SEQ ID NO: 516 - protein, 534 aa, Arabidopsis thaliana; identical to SEQ ID NO: 44

SEQ ID NO: 517 - DNA, 1407 bp, Arabidopsis thaliana
atgtctgggaataacgagttgaacgcactaaaagggcctcaaagctctctgccttggccatttggaatggcctctgcatcgtttgctccctcccacatggcccctcctaactttcaacctcagtttcagctctctcaagaccaagggattagtgctcctggaagaaggttcccacataaacctcccattggaggacctcctgctgttcctcctagtatggagttgactccagcttccaggaaaaagaaacataagcttccagacaagtcctccttgcaggagcgcgttgctgccgtcttgcccgagtctgctctctacacacagcttcttgagtttgagtctcgggttgatgccgctctcttcagaaagaaagttgacatccaagactcccttaagaaccctccttccattcagaagacccttaggatctacgttttcaacaccttttccaaccagatccctggtcctgaccctcccacatggactcttaggattttcggcagggtcctggatcctgaccacactggtggattagttcagaattcaaacccactttatcccaagttctcgtctttcttcaaaacgttaaagatatccctggaccagagcctgtatcctgagaaccatctgatcgaatggaaaagggatcgatcgcctgctcctctggaagggtttgagataaagaggatagggtgtcaggagtttgcagctactatactgttggagatgaattacgtccctgagaagttcaagacttctcctgctttgatgcaagttttgggcattgaggttgacactcgcccaagaatcattgcggcaatctggcattacgtgaaagtcaggaaactgcaaaacccaaacgacccttctttcttcaactgtgatgctgctctccacagtgtttttggggaagagaagatgaaattcactatgctctctcataagatatctcagcacctatcacctccgcctcccattcagcttgtacacaagatcaagctttcggggaacaatccagccatctcagcatgttacgatgtgcttgtggacataccagcaccggtccaaacggagctttccaatctgctcgctaatccagagaagaacaaagagattgaggcatgtgatgaagccatatgcggagccataaggaaaatccacgagcacagaaggagacgggcgtttttcttagggtttagccagtcaccggtggaattcaccaatgccttgatggaatctcagaccaaagatctgaagcttgttgcaggagaagcaagtcgaaacgctgagaaagaaggccgatcagagttcttcaatcagccatgggtggaggatgctgcaatacgttacttgaaccggaagccagcaggcgggtaagatgcagatgggccaagaagttcatgagtt

SEQ ID NO: 518 - protein, 458 aa, Arabidopsis thaliana
MSGNNELNALKGPQSSLPWPFGMASASFAPSHMAPPNFQPQFQLSQDQGISAPGRRFPHKPPIGGPPAVPPSMELTPASRKKKHKLPDKSSLQERVAAVLPESALYTQLLEFESRVDAALFRKKVDIQDSLKNPPSIQKTLRIYVFNTFSNQIPGPDPPTWTLRIFGRVLDPDHTGGLVQNSNPLYPKFSSFFKTLKISLDQSLYPENHLIEWKRDRSPAPLEGFEIKRIGCQEFAATILLEMNYVPEKFKTSPALMQVLGIEVDTRPRIIAAIWHYVKVRKLQNPNDPSFFNCDAALHSVFGEEKMKFTMLSHKISQHLSPPPPIQLVHKIKLSGNNPAISACYDVLVDIPAPVQTELSNLLANPEKNKEIEACDEAICGAIRKIHEHRRRRAFFLGFSQSPVEFTNALMESQTKDLKLVAGEASRNAEKEGRSEFFNQPWVEDAAIRYLNRKPAGG

SEQ ID NO: 519 - DNA, 1617 bp, Brassica napus
atgtctgctaacaacaacaatccacagaagcctcaacaaggctctgcgccttcacccttcggcggtaaccctgggatggcctctgcatctgttcccggaaaccaaggcttcactcagcctcacatggcacctaactttccagctcagtttcaattctcacaagcccaggccatggcccatgctcaagcccaagcccagtctaaagcccaagctcagttccaagctcagatgcaagcagggatgactatgaaccaagggcaaggctcccaggggattggtggtgtgttgggttcgtcttctccttccatgactcctggtagcttgaacatgaagaggttccagcagaggccgccgatgcggcctccttctggtttccccgcgagtaacaacactgtctcccccatgagaacgatggagttgactcctgctgcgaggaagaagaagatgaagcttcctgagaagtcgttgcaggagagggtggcagcaatcttgcctgagtctgcgttgtacacgcagcttcttgagtttgagtcaagggtcgatgctgctttgagtaggaagaaagttgacatccaggaggctcttaagaaccctccttgcactcagaagacgcttaggatctatgtgttcaactcgtttgctaaccaaaacaataccatccctgggaatccaaacgctgacccgccgacatggactcttaagattgttggtaggatcttggaagatggggtggatccggaccagccaggttttgttcagcaagcaaacccgtcgcatcccaagttctcgtctttcttcaagaaggtaatagttaacctggaccagaggctgtatcctgagaactcggcgatcacatgggagagcgctagatcacctgctcctcaggaagggtttgagataaagaggaaagggaatcaggagtttgcagctactattaggttggagatgaactacgttcctgagaagttcaagctttctactgcgttgatggatgttctcgggattgaggttgagaccagaccaagaataatctctgcgatatggcattacgttaaggcgaggaaactgcagaacccaaacgacccttctttcttcaactgcgacgctgcgcttcacaaagtgtttggggaagagaaggtgaagttcacaatggtctctcagaagatatctcatcacttgtcacctccaccgccgattcatttagaacacaagatcaagctgtcgggaaacaacccggctatatcggcatgttacgatgtcctggtggatgtgccgtttccgattcagagggatctgaacaacttgttggccaacgcagagaagaataaagagattgaggcttgtgatgaagcgatatgtgcagccattaggaaaatccatgagcataggaggagacgtgcatttttcttgggatttagtcagtcgccggttgagttcataaacgcactgatcgaatctcagagcaaggatctgaaggttgtagcgggtgaagccagtcgaaatgctgagaaagaacgtcgagcagacttcttcaatcaaccttgggttgaggatgcggtaatacgttacttgaaccggaagccagcagctgggaacgaaggaccaggaacctggtga

SEQ ID NO: 520 - protein, 538 aa, Brassica napus
MSANNNNPQKPQQGSAPSPFGGNPGMASASVPGNQGFTQPHMAPNFPAQFQFSQAQAMAHAQAQAQSKAQAQFQAQMQAGMTMNQGQGSQGIGGVLGSSSPSMTPGSLNMKRFQQRPPMRPPSGFPASNNTVSPMRTMELTPAARKKKMKLPEKSLQERVAAILPESALYTQLLEFESRVDAALSRKKVDIQEALKNPPCTQKTLRIYVFNSFANQNNTIPGNPNADPPTWTLKIVGRILEDGVDPDQPGFVQQANPSHPKFSSFFKKVIVNLDQRLYPENSAITWESARSPAPQEGFEIKRKGNQEFAATIRLEMNYVPEKFKLSTALMDVLGIEVETRPRIISAIWHYVKARKLQNPNDPSFFNCDAALHKVFGEEKVKFTMVSQKISHHLSPPPPIHLEHKIKLSGNNPAISACYDVLVDVPFPIQRDLNNLLANAEKNKEIEACDEAICAAIRKIHEHRRRRAFFLGFSQSPVEFINALIESQSKDLKVVAGEASRNAEKERRADFFNQPWVEDAVIRYLNRKPAAGNEGPGTW

SEQ ID NO: 521 - DNA, 1647 bp, Vitis vinifera
atggctgtgaataacaataatccacccaagaaccttggggcttcttcttcgccctttggcaatgccggaatgggttctcctgctatgcctgcaaatcctgtgttctcgcaaccgcaagctcaggggcaaattgggggtggctttcagggtcagtttcagctgtcccaggctcatcaagcccatgtcattgcccaggcacattctaaagcacaagctcatgcccaagctcaagcgcaggctgcccacgcccagttccaagctcagttacaggctcaaggaatgacccttaatcagtcccaaggcattgggattgggaatatgggtggatcttcaccctccataggagcacccggcaattcaaacatgaaacggactttgcagaagcctccagtacgccctcctggccctttaggtgctaatactatctctcctttgaaagtcatggaacttacacctgctgcccgcagaaagaagcagaagcttccagagaagcaattacaagatagagtggcagcaattctgccagagtctgctttgtacacacaactccttgagtttgagagtcgagttgatgctgctctagctaggaagaaaattgacattcaagaggcacttaaaaaccctccttgtgttcaaaaaactcttcgaatttatattttcaacactttcgctaatcagattcgcacaattcccaagaagccaaatgcagagccacctacctggaccctcaagataattgggaggatcttggaagaaggggtagatcctgaccaggctgcaatgctccacaaatcaaatgtctcgtacccaaaattctcgtctttcttcaagagagtcaccatttcccttgaccagagactatatcctgataaccctattattatatgggagaatgctcgatccccagcacctcatgagggctttgaggtaaagagaaagggggataaagaatttactgtgaatatacggttagaaatgaattatgtgcctgagaagtttaagctttcttcagctttgatggaagttcttggtattgaggttgatacacgcccaagaattatagctgcaatatggcattatgtgaaggctagaaaattgcagaaccccaatgacccttcatttttcaattgtgatccgcctcttcagaaagtgttcggggaagacaagatgaaattcaccatggtgtcacagaagatatcacagcatttgtctcctccgcaacctatacatttggaacataagatcaagctttcggggaattgtccagctggaaatgcatgctatgatgtgttggttgatgtcccctttccaatacagaaggaattgtctgctttattggctaacacggagaaaaacaaagagatcgatgcatgtgatgaagcaatttgttctgctataagaaagatacatgaacaccgtcggaggcgggcattctttcttgggtttagtcaatctcctgtggaatttattaacactttgattgaatctcaaagcaaagatctgaagctagtggctggggaagctagtcgcaatgctgaaaaggagcggcgatcggacttcttcaaccagccatgggttgaagatgctgtcattcgttatctgaatcgcaagccagttgctggaagtgacgctcctgggagtacatga

SEQ ID NO: 522 - protein, 548 aa, Vitis vinifera
MAVNNNNPPKNLGASSSPFGNAGMGSPAMPANPVFSQPQAQGQIGGGFQGQFQLSQAHQAHVIAQAHSKAQAHAQAQAQAAHAQFQAQLQAQGMTLNQSQGIGIGNMGGSSPSIGAPGNSNMKRTLQKPPVRPPGPLGANTISPLKVMELTPAARRKKQKLPEKQLQDRVAAILPESALYTQLLEFESRVDAALARKKIDIQEALKNPPCVQKTLRIYIFNTFANQIRTIPKKPNAEPPTWTLKIIGRILEEGVDPDQAAMLHKSNVSYPKFSSFFKRVTISLDQRLYPDNPIIIWENARSPAPHEGFEVKRKGDKEFTVNIRLEMNYVPEKFKLSSALMEVLGIEVDTRPRIIAAIWHYVKARKLQNPNDPSFFNCDPPLQKVFGEDKMKFTMVSQKISQHLSPPQPIHLEHKIKLSGNCPAGNACYDVLVDVPFPIQKELSALLANTEKNKEIDACDEAICSAIRKIHEHRRRRAFFLGFSQSPVEFINTLIESQSKDLKLVAGEASRNAEKERRSDFFNQPWVEDAVIRYLNRKPVAGSDAPGST

SEQ ID NO: 523 - DNA, 1392 bp, Oryza sativa
atgctgccacctgcatcgccgcctgctgtccgtcagtgcctctccttcacctcccaccgcatcgctgcctgccgccgagaggcgcccctcatgaagggagagagcgaggaggaagaaacggccgctgccgccgcggccgccgtgggggcgaactccgccggcggcgtcgacctcaccccggccgccgcgcggcgcaacaagaagcggaagctccccgagaagcagctccccgaccgcgtcgccgcgctgctcccggagtcggcactgtacactcagctgctcgagttcgagtcccgcgtcgacgccgcgctgcaccgcaagaaggtggacatccaggaggcgctcaagtcaccccccgcgctgcagcgcacgctccgcatctacgtgttcaacaccttcgccaaccaggcgccgcgcaccatcccgccgcccaagaacgccgagccgcccacctggtcgctcaagatcatcggccgcgtgctcgaggacggcgccgagctggaccccgccagcgtcgtgcccaagcacaaccctgtgtaccccaagttctcgtccttcttcaagagggtgacgattgcgctcgacccgtcgctgtacccggagaacccgctgatcatttgggagaatgcgcggtcggccgccccacaggaagggttcgaggtgaagaggaaaggggataaggagttctccgcgaatatccggctggagatgaactataaccctgagaagttcaagctctcgcagcctctgatggaggtgctcggggttgaggtggacactcgttcgagggtgattgctgccctctggcagtacatcaaagcgaagaagctgcagaatccaaccgatccttcgttctttatgtgtgatccacagttgaagaaggtctttggggaggataagctgaggtttgcgatgctatcgcagaagatatcacagcatctctctcctccgccgcccatcaacttggagcataagattaagctctctgggaatggcgcgcatgcgagtgcttgctatgatgtgattgtggatgttcctttccctctgcagaaggagatgtctgcatttcttgccaacactgagaagcacaaggacattgaggcatgtgatgaggtgatatctgcttcgatcaagaagatccatgagcaccgcaggaggagggcattcttccttggtttcagccagtccccagtggagttcatcaatgcactgatagcgtctcagagtaaagatttgaagctgatcgcaggagaagcaaataggaatattgaaagagaaagacgtgcagacttctataatcaaccatgggttgaggatgctgtcataagatacctgaaccgcaaaccggctagcggtaatgagggcccaggcggtggtgctggtggttcatga

SEQ ID NO: 524 - protein, 463 aa, Oryza sativa
MLPPASPPAVRQCLSFTSHRIAACRREAPLMKGESEEEETAAAAAAAVGANSAGGVDLTPAAARRNKKRKLPEKQLPDRVAALLPESALYTQLLEFESRVDAALHRKKVDIQEALKSPPALQRTLRIYVFNTFANQAPRTIPPPKNAEPPTWSLKIIGRVLEDGAELDPASVVPKHNPVYPKFSSFFKRVTIALDPSLYPENPLIIWENARSAAPQEGFEVKRKGDKEFSANIRLEMNYNPEKFKLSQPLMEVLGVEVDTRSRVIAALWQYIKAKKLQNPTDPSFFMCDPQLKKVFGEDKLRFAMLSQKISQHLSPPPPINLEHKIKLSGNGAHASACYDVIVDVPFPLQKEMSAFLANTEKHKDIEACDEVISASIKKIHEHRRRRAFFLGFSQSPVEFINALIASQSKDLKLIAGEANRNIERERRADFYNQPWVEDAVIRYLNRKPASGNEGPGGGAGGS

SEQ ID NO: 525 - DNA, 1671 bp, Oryza sativa
  misc_feature (357)..(358): n is a, c, g, or t
atggccaccggcggcaaccccaacccgaactccacgccgacccctcagccgcgcccgccccagccgcagcagcagggcggctccccggcgaccccgctcggccacctccgcccgccttccctcgcgggctcccccttccagggcctcttccacaccccgccccagcacaacccggccttccagatccacatgggcgccgacgcctcgccgcagaacccgcttatggccgctgccgccgccgccgccaacacagcaggcactcacagcacaaagcagccacatccaccaagaagcacacaccgcagcggcaccaccgcacccagggctcctcactcctccagggggcggcgcaacagnncacgcacgccagccgcggccgcgtccgcggccgcggcgtacaaggccgctgccgccgcggccgccgtgggggcgaactccgccggcggcgtcgacctcaccccggccgccgcgcggcgcaacaagaagcggaagctccccgagaagcagctccccgaccgcgtcgccgcgctgctcccggagtcggcactgtacactcagctgctcgagttcgagtcccgcgtcgacgccgcgctgcaccgcaagaaggtggacatccaggaggcgctcaagtcaccccccgcgctgcagcgcacgctccgcatctacgtgttcaacaccttcgccaaccaggcgccgcgcaccatcccgccgcccaagaacgccgagccgcccacctggtcgctcaagatcatcggccgcgtgctcgaggacggcgccgagctggaccccgccagcgtcgtgcccaagcacaaccctgtgtaccccaagttctcgtccttcttcaagagggtgacgattgcgctcgacccgtcgctgtacccggagaacccgctgatcatttgggagaatgcgcggtcggccgccccacaggaagggttcgaggtgaagaggaaaggggataaggagttctccgcgaatatccggctggagatgaactataaccctgagaagttcaagctctcgcagcctctgatggaggtgctcggggttgaggtggacactcgttcgagggtgattgctgccctctggcagtacatcaaagcgaagaagctgcagaatccaaccgatccttcgttctttatgtgtgatccacagttgaagaaggtctttggggaggataagctgaggtttgcgatgctatcgcagaagatatcacagcatctctctcctccgccgcccatcaacttggagcataagattaagctctctgggaatggcgcgcatgcgagtgcttgctatgatgtgattgtggatgttcctttccctctgcagaaggagatgtctgcatttcttgccaacactgagaagcacaaggacattgaggcatgtgatgaggtgatatctgcttcgatcaagaagatccatgagcaccgcaggaggagggcattcttccttggtttcagccagtccccagtggagttcatcaatgcactgatagcgtctcagagtaaagatttgaagctgatcgcaggagaagcaaataggaatattgaaagagaaagacgtgcagacttctataatcaaccatgggttgaggatgctgtcataagatacctgaaccgcaaaccggctagcggtaatgagggcccaggcggtggtgctggtggttca

SEQ ID NO: 526 - protein, 557 aa, Oryza sativa
  misc_feature (119)..(120): Xaa can be any naturally occurring amino acid
MATGGNPNPNSTPTPQPRPPQPQQQGGSPATPLGHLRPPSLAGSPFQGLFHTPPQHNPAFQIHMGADASPQNPLMAAAAAAANTAGTHSTKQPHPPRSTHRSGTTAPRAPHSSRGRRNXXRTPAAAASAAAAYKAAAAAAAVGANSAGGVDLTPAAARRNKKRKLPEKQLPDRVAALLPESALYTQLLEFESRVDAALHRKKVDIQEALKSPPALQRTLRIYVFNTFANQAPRTIPPPKNAEPPTWSLKIIGRVLEDGAELDPASVVPKHNPVYPKFSSFFKRVTIALDPSLYPENPLIIWENARSAAPQEGFEVKRKGDKEFSANIRLEMNYNPEKFKLSQPLMEVLGVEVDTRSRVIAALWQYIKAKKLQNPTDPSFFMCDPQLKKVFGEDKLRFAMLSQKISQHLSPPPPINLEHKIKLSGNGAHASACYDVIVDVPFPLQKEMSAFLANTEKHKDIEACDEVISASIKKIHEHRRRRAFFLGFSQSPVEFINALIASQSKDLKLIAGEANRNIERERRADFYNQPWVEDAVIRYLNRKPASGNEGPGGGAGGS

SEQ ID NO: 527 - DNA, 1266 bp, Physcomitrella patens
atgggagcgaacaatgcgggtgggaacacgtcgtctgcgtttaaggtagcggatgtgtcccccgccgcgaggcggaagaagcagaaagtggcggacaagcagattcctgataaggtcgctgctctgttgcccgaatctgctatttacacccagctcgtggagtttgaggcgcgcgtggacgcggcgctggctaggaaaaagcttgacattcaggaggttgtgcgatcgccgccccctgtggagcgcgttttgagaatgtatgttttcaatacgtatgctaatcagactccgaaccctaattcttcatttcagcagcattatgtggagccgccgtcatggacgctgaggattatggggcgtgttctggagggcgatgatgtggaggctaatgggaatggctcgaaaccggcgaactcttcgttgccgaaattctcgtcgtttttcaagaggataactattcaattggacccggtgcattacccggaaaacaatatgattgtatgggatagtgctagggcttccaatcatgttgagggttttgagattaagaggcggggaaatgtcgactgtgatgttaacatatggttggaaatggatcataccccggaaaggtttaagttgtcacctgctctagctcaagtacttggcgtcgaggtggatacgcggccacatgttatagctgctgtgtggcaatatatcaagactaagaaactccagaatccagtggatccgaccatgatcaactgcgacgatgcattacaaaaagtctttgatgatgagaagataaaatttgcgtcgatatctgcaagactacaccagcacatgaatccaccacaacccatacagttgtaccacagaatcaaggtgtcagggagtatgccagcgggtaacgcgtgttatgatgtgaacgttaacataccggcgcctctgcttaaagaaatgaatcagtttctgaccaacattgagaagcacagggatattgatctatatgacgacatgatagcaaacactatacggaagattaacgagcatcgccggcgtcgagcttactttcttgggttcagtaattctccggtggattttatcaacggtttgattgcctctcaaagccgggaccttaaaatggtcgttgggcagaatagtcggaacgcggagaaggagcgaagatccgatttttacaatcagccatgggtggaagatgcagtaattcggtacttgaatcgacgaccggccaagggctcggaaggtccggggaacaattcatga

SEQ ID NO: 528 - protein, 421 aa, Physcomitrella patens
MGANNAGGNTSSAFKVADVSPAARRKKQKVADKQIPDKVAALLPESAIYTQLVEFEARVDAALARKKLDIQEVVRSPPPVERVLRMYVFNTYANQTPNPNSSFQQHYVEPPSWTLRIMGRVLEGDDVEANGNGSKPANSSLPKFSSFFKRITIQLDPVHYPENNMIVWDSARASNHVEGFEIKRRGNVDCDVNIWLEMDHTPERFKLSPALAQVLGVEVDTRPHVIAAVWQYIKTKKLQNPVDPTMINCDDALQKVFDDEKIKFASISARLHQHMNPPQPIQLYHRIKVSGSMPAGNACYDVNVNIPAPLLKEMNQFLTNIEKHRDIDLYDDMIANTIRKINEHRRRRAYFLGFSNSPVDFINGLIASQSRDLKMVVGQNSRNAEKERRSDFYNQPWVEDAVIRYLNRRPAKGSEGPGNNS

SEQ ID NO: 529 - DNA, 1611 bp, Populus trichocarpa
atgaataataatagtagtaatcctggaagaagtattggggttccgccctcgtttgtgaattctgttgcaaaggcacaatctatgcacgtgaaccaccaagcaccgcagttgctatcacagtcacaacctcaaacacaagttgggcatccgggccactttcagctgtccgagccgcaagctcaggtcctgggacatgctcagtatgcacaggcagctcatgctcactttcaatctcagatacaattggccaaccaatccattgctcagttgcaaaatgtcaattctggtaatgttggtgtacaatcacctcctgtagccacgcctagcattactagtgctaaaaagtccagccataaaccgccttcaaggccttcaggtggttcatcaaatgccaacatggcttcactgtttaagaccatggagttgactccagctgctcataggaagaaaaggaagcttcatgagaaggagatacctgaaaaagtggcagctcttttgccagagtctgcactttatacccagctgcttgaatttgaggctagagcggatgctgctatggcaagaaagaagatggatattcaagagtcacttaaaaaccctccacgtgttcggaaaacacttcgggtatatgtatttaacacttttgaaaatcaggtgcaaggggctaacgagaggaagaatgctgagcctccttcttggtcattaaagatcattgggaggatattggaagatgggaaagaccctgtgctgactggaatgatccagaaatcatatccaaaattctcgtcttatttcaagaaaattacaatatacttggaccagagcctgtatccagataaccatgtaattttatgggagagcacacggtcacctgttcttcatgagggctttgaggtcaagagaaaaggaaataaggaatttactgcaagaattaggctggaaatgaattatgtgcctgagaaattcaagctttcacctgctctttcagaagtccttggaattgagatagagactcgccccagaattttggcggcaatttggcattatgtgaagtctaggaagttgcagaacccaaatgatccctccttcttcacatgtgacccccttcttcagaaactatttggggaagagaagatgaaattttctctggtttcacagaagataagtctgcatttaacccctccacagcctattcatttggaacataagatcaagctctcagggaatttcccagctggaactacttgctatgatttcatagtcgatgttccttcaccattacaaaaggaccttgctgcgtacttgaccagcacagagagtaacaaagaaattgatgcttgtgatgaattaataagtaactctatactgaagatacatgagcatcgtcggaggcgggctttctttcttggtttcagtcagtctccagcagagtttattaatgctttgattgcttctcagagcaaagatctgaagcttgtcgctggagatgctagccgcaatgcagaaaaagagcagcgatctggtttctataatcagccatgggtggaagatgctgttattcgttacctaaatcgcaagtctacaggaagtgatgctcctggaagctcttga

SEQ ID NO: 530 - protein, 536 aa, Populus trichocarpa
MNNNSSNPGRSIGVPPSFVNSVAKAQSMHVNHQAPQLLSQSQPQTQVGHPGHFQLSEPQAQVLGHAQYAQAAHAHFQSQIQLANQSIAQLQNVNSGNVGVQSPPVATPSITSAKKSSHKPPSRPSGGSSNANMASLFKTMELTPAAHRKKRKLHEKEIPEKVAALLPESALYTQLLEFEARADAAMARKKMDIQESLKNPPRVRKTLRVYVFNTFENQVQGANERKNAEPPSWSLKIIGRILEDGKDPVLTGMIQKSYPKFSSYFKKITIYLDQSLYPDNHVILWESTRSPVLHEGFEVKRKGNKEFTARIRLEMNYVPEKFKLSPALSEVLGIEIETRPRILAAIWHYVKSRKLQNPNDPSFFTCDPLLQKLFGEEKMKFSLVSQKISLHLTPPQPIHLEHKIKLSGNFPAGTTCYDFIVDVPSPLQKDLAAYLTSTESNKEIDACDELISNSILKIHEHRRRRAFFLGFSQSPAEFINALIASQSKDLKLVAGDASRNAEKEQRSGFYNQPWVEDAVIRYLNRKSTGSDAPGSS

SEQ ID NO: 531 - DNA, 1644 bp, Populus trichocarpa
atgtctatgaacaacaactccacaccaaagagtttggggcaatcttcgtcaccacttggtaattcggggatggtcaatccatcgatgggagcgaacccatccttctcacaatcacaaggacaaatgggtgctgcctttcagggtggtcagttccagctgtcccaagcacaggctactgtgcaagctcacttgaaagcacagcaggctcacgctcaagcacaagcagttcatgctgctcaaattcaagcagctcatgtgcaactccaagcacaagggatctctcttaaccaaactcagaatgttggcataggtaatttgggttcgtcttcaccgtcattctcaactcccgggaatgctagtgcaaaacggctccctcagaaacctttgggtaggcctcctggtgttcccatttctagcatggtttcaccattgaaacctatggatctctcatctgctgcacgtagaaagaagcagaagctaccagagaagcagctacaagatagagtagctgcaattctgccagagtctgctctgtacacacagcttcttgagtttgaagctcgtgttgatgctgctttagctagaaagaaggttgacatccaggaggcccttaaaagtcctccttgtgtgcagaaaacccttcgaatttatgtcttcaatacatttgccaatcagacaagaacaatccccaagaagccaaatgctgagcctcctacttggactcttaaagttatcgggagaatcttggaagatgggttagaccctgaccagcctggagcagtccagaaatcaaaccccttgtacccgaagttctcatcttttttcaagagagtgaccattcagttggatcagagactgtatcctgataatcatatcatcatatgggagcatgctcgatcacctgcacctcacgagggttttgaagtcaagagaaaaggggataaagagttcactgtgaatataagattggaaatgaattatgtgcctgagaaatttaagctctctccagctttgatggaagttcttggtatagaggttgaaacccgtcctagaataatagctgcaatttggcattatgtgaaggctaggaaactgcagaaccctgatgacccttcatttttcatttgcgatgcacctcttcagaaagtatttggggaatcaaagatgaaattcacgatggtttcacagaggatatctccgcatttatctcctccacagccgatacatttggagcataaaattaagctttcagggaatagtccagctggaactgtctgctatgatgtgctggtggatgtgccatttccaatacagagggaattgtttgctttgttggcaaatgccgagaagaataaagagattgatacctgtgatgaggcaatatgtactgctataaggaaaattcatgaacatcgaaggagacgggcattcttccttggatttagtcaatcacctgtggaatttgtcaatgctctgattgaatctcaaagcaaggatttgaggctggtagctggagaagctagcagaaatgctgagaaagagcgccgctcggacttctttaaccaaccatgggttgaagatgctgttattcgttacttgaatcgcaagcctgctgtaggaagtgatgctcctgggagcacatga

SEQ ID NO: 532 - protein, 547 aa, Populus trichocarpa
MSMNNNSTPKSLGQSSSPLGNSGMVNPSMGANPSFSQSQGQMGAAFQGGQFQLSQAQATVQAHLKAQQAHAQAQAVHAAQIQAAHVQLQAQGISLNQTQNVGIGNLGSSSPSFSTPGNASAKRLPQKPLGRPPGVPISSMVSPLKPMDLSSAARRKKQKLPEKQLQDRVAAILPESALYTQLLEFEARVDAALARKKVDIQEALKSPPCVQKTLRIYVFNTFANQTRTIPKKPNAEPPTWTLKVIGRILEDGLDPDQPGAVQKSNPLYPKFSSFFKRVTIQLDQRLYPDNHIIIWEHARSPAPHEGFEVKRKGDKEFTVNIRLEMNYVPEKFKLSPALMEVLGIEVETRPRIIAAIWHYVKARKLQNPDDPSFFICDAPLQKVFGESKMKFTMVSQRISPHLSPPQPIHLEHKIKLSGNSPAGTVCYDVLVDVPFPIQRELFALLANAEKNKEIDTCDEAICTAIRKIHEHRRRRAFFLGFSQSPVEFVNALIESQSKDLRLVAGEASRNAEKERRSDFFNQPWVEDAVIRYLNRKPAVGSDAPGST

SEQ ID NO: 533 - DNA, 1668 bp, Populus trichocarpa
atgtctatgaacaacaacaacaacaataataacccgccaaagagtttggggcaatcttcgtcaccattcggtaattcagggatggtcaatccatcgatgggcgcgaacccaacattcccacaagcgcaagcgcagatgggtgctggctttcagggtggtcagttccagctgtcccaagcacaggctactttgcaagcccatttgaaagcgcagcaggctcatgctcaggcacaagcagctcacgctgctcaagttcaagcagctcatgcacaattccaagcgcaattacaagcgcaaggggtttctcttaaccaaaatcagagtgctggaataggcaatttgggttcatcttcaccgtcattctcgactcctggcaatgctagtgcaaaacggctccctcagaaacctctgggtagacctcctggtgttcccatgtcgagcatggtttcaccattgaaacccatggatctttcttccgctgcacgtaggaagaagcagaagctaccagagaagcagctacaagatagagtagcagcaattctgccagagtctgctctgtacacccagcttcttgagtttgaaacccgtgttgatgctgctttagctagaaagaaggtcgacatccaggaggcgcttaaaagccctccttgtgttcagaaaacccttcgaatttatgtcttcaatacatttgccaatcagataagaacaatccccaagaagccaaatgctgaccctccgacttggactcttaaagttatcgggagaatcttggaagatggggtagaccctgaccagcctggagcagtccagaaatcaaacccattgtacccaaagttctcatcttttttcaagagagtgtcaattcagttggatcagagactatatcctgataatcatatcattatatgggagcatgctcgatcacctgcacctcacgagggttttgaagtcaagagaaaaggggacaaagagttctctgtgaatatacgattggaaatgaattatgtgcctgagaaatttaagctctctccagctttgatggaagttcttggtatagaggttgaaacccgtcctagaataatagctgcaatttggcattatgtgaaggctaggaaactgcagaaccctgaggacccttcatttttcaattgcgacgcacctcttcagaaagtatttggggaatcaaagatgaagttcacgatggtttcacagaggatatctcagcatttatctcctccacagccgatacatttggagcataaaattaagctatcggggaatagtccagctggaactgtctgctatgatgtggtggttgacgtgccattcccaatacagagggagttgtctgctttgttggcaaatgctgagaagaataaagagattgatacttgtgatgaggcgatatgtactgctataaggaaaattcatgaacatcgtcggagacgcgcattcttccttggatttagtcaatcacctgtcgaatttgtcaatgctctcattgaatctcaaagcaaggatttgaagctggtagctggagaagctagtagaaatgccgagaaagagcgccgctcagatttctttaaccagccatgggttgaagatgctgtaattcgatatttgaatcgcaagcccgctgccggaagcgatgctcctcggagcatgtga

SEQ ID NO: 534 - protein, 555 aa, Populus trichocarpa
MSMNNNNNNNNPPKSLGQSSSPFGNSGMVNPSMGANPTFPQAQAQMGAGFQGGQFQLSQAQATLQAHLKAQQAHAQAQAAHAAQVQAAHAQFQAQLQAQGVSLNQNQSAGIGNLGSSSPSFSTPGNASAKRLPQKPLGRPPGVPMSSMVSPLKPMDLSSAARRKKQKLPEKQLQDRVAAILPESALYTQLLEFETRVDAALARKKVDIQEALKSPPCVQKTLRIYVFNTFANQIRTIPKKPNADPPTWTLKVIGRILEDGVDPDQPGAVQKSNPLYPKFSSFFKRVSIQLDQRLYPDNHIIIWEHARSPAPHEGFEVKRKGDKEFSVNIRLEMNYVPEKFKLSPALMEVLGIEVETRPRIIAAIWHYVKARKLQNPEDPSFFNCDAPLQKVFGESKMKFTMVSQRISQHLSPPQPIHLEHKIKLSGNSPAGTVCYDVVVDVPFPIQRELSALLANAEKNKEIDTCDEAICTAIRKIHEHRRRRAFFLGFSQSPVEFVNALIESQSKDLKLVAGEASRNAEKERRSDFFNQPWVEDAVIRYLNRKPAAGSDAPRSM

SEQ ID NO: 535 - DNA, 1257 bp, Triticum aestivum
  misc_feature (748)..(748): n is a, c, g, or t
atggccgccgcttataaggctgctaactccggcagcgtcgacctcacccccgctgcgcgccgcaacaagaagcgcaaactcccggagaagcagctcccggaccgcgtcgccgcgctgttgccagagtccgcgctctacacgcagctcctcgagttcgaggcccgcgtagacgcagcgctcgcgcgcaagaaggtggacattcaggaggcgctcaagacaccaccgtccctccagcgcacgctccgcatctacgtcttcaacaccttcgccaaccaggcgccccgcaccatcccgccgcccaagaatggcgatccgcccacctggtcgctcaagatcattggccgtgtgcttgaagacggcgcggacgtggacccagccagtgtcgtgccgaagcacaacccagtgtatccgaaattctcctcgttctttaagagggtgactattgctcttgactcgtcactctatccagagaacccactgattgtctgggagaatgcccggtctgctgcgccgcaggaagggtttgaggtgaagaggaaaggggataaggagtttcttgccaatatccgtctggagatgaattacaaccccgagaagttcaagctgtcacagccactaatggaggtgcttggggtcgaggtggacactcgcgcaagggtgatcgcagccctttggcagtacatcaaggcaaagaagctacagaatccaagtgacccttcctactttatgtgtgacccccaactgaaanaaggtatttgggggaaggataaaatgaggtttgctatgctgtctcagaagatatcacaacatcttgctcctccaccgcccatcaacttggaacataagatcaagctatcagggaatggagcaaactcgagtgcttgctatgatgtattggtagatgttcctttcccactgcagaaggagatgacagcatttcttgccaatactgagaagcacaaggacattgaggcatgtgatgaggtgatatctgcttcaatcaagaagatccatgagcatcgtaggaggagggcgttcttccttgggttcagccagtccccagtggaattcattaatgcgttgatagcatcccagagtaaagatttgaagcttgttgctggtgaagcgagtaggaatattgaaagggaaaggcgtgcggacttctataaccagccatgggttgaggatgctgttataagatatttgaatcgtaaaccgcctggtggcaacgatggccctggtgctggtggttcttga

SEQ ID NO: 536 - protein, 418 aa, Triticum aestivum
  misc_feature (250)..(250): Xaa can be any naturally occurring amino acid
MAAAYKAANSGSVDLTPAARRNKKRKLPEKQLPDRVAALLPESALYTQLLEFEARVDAALARKKVDIQEALKTPPSLQRTLRIYVFNTFANQAPRTIPPPKNGDPPTWSLKIIGRVLEDGADVDPASVVPKHNPVYPKFSSFFKRVTIALDSSLYPENPLIVWENARSAAPQEGFEVKRKGDKEFLANIRLEMNYNPEKFKLSQPLMEVLGVEVDTRARVIAALWQYIKAKKLQNPSDPSYFMCDPQLKXGIWGKDKMRFAMLSQKISQHLAPPPPINLEHKIKLSGNGANSSACYDVLVDVPFPLQKEMTAFLANTEKHKDIEACDEVISASIKKIHEHRRRRAFFLGFSQSPVEFINALIASQSKDLKLVAGEASRNIERERRADFYNQPWVEDAVIRYLNRKPPGGNDGPGAGGS

SEQ ID NO: 537 - DNA, 1578 bp, Triticum aestivum
atggccaccggcggcaaccccaatcccaacgccaaccccggccagccacgcccgcagcagcagccgccgggaagctctccggcgaccccgcataaccacatgcgcccccccactctcggcggttccccctttcagggtcttttccacaccccgcctagccacaatcctgctttccagattcacatgggcgcagcctcctctccccagaccccactaatggccgcggccgcggccgcggcctccgccgccgcatcggccaagcgccctccccagaagcccccttcgcgtccgccggcacccacctccaacgccgccgcagcgtccatggccgccgcttataaggctgctaactccggcagcgtcgacctcacccccgctgcgcgccgcaacaagaagcgcaaactcccggagaagcagctcccggaccgcgtcgccgcgctgttgccagagtccgcgctctacacgcagctcctcgagttcgaggcccgcgtagacgcagcgctcgcgcgcaagaaggtggacattcaggaggcgctcaagacaccaccgtccctccagcgcacgctccgcatctacgtcttcaacaccttcgccaaccaggcgccccgcaccatcccgccgcccaagaatggcgatccgcccacctggtcgctcaagatcattggccgtgtgcttgaagacggcgcggagctggacccagccagtgtcgtgccgaagcacaacccagtgtatccgaaattctcctcgttctttaagagggtgactattgctcttgattcgtcactctacccagagaacccactgatcgtttgggagaatgcccggtctgctgcgcctcaggaagggtttgaggtgaagaggaaaggggataaggagtttcttgccaatatccgtctggagatgaattataaccctgagaagttcaagctgtcacagccactgatggaggtgcttggggtcgaggtggacactcgtgcaagggtgattgcagccctttggcagtacatcaaggcaaagaagctacagaatccaagcgacccttcgtactttatgtgtgacccccaactgaagaaggtatttggggaggataaaatgaggtttgctatgctgtctcagaagatatcgcaacatcttgctcctccaccgcccatcaacttggaacataagatcaagctatcagggaatggagcaaactcgagtgcttgctatgatgtattggtagatgttcctttcccactgcagaaggagatgacagcatttcttgccaatactgagaagcacaaggacattgaggcatgtgatgaggtgatatctgcttcaatcaagaagatccatgagcatcgtaggaggagggcgttcttccttgggttcagccagtctccagtggagttcattaatgcgttgatagcatcccagagtaaagatttgaagcttgttgctggtgaagcgagtaggaatattgaaagggaaaggcgtgcagacttctataaccagccatgggttgaggatgctgttataagatatttgaatcgtaaaccgcctggtggcaacgatggccctggtgctggtggttcttga

SEQ ID NO: 538 - protein, 525 aa, Triticum aestivum
MATGGNPNPNANPGQPRPQQQPPGSSPATPHNHMRPPTLGGSPFQGLFHTPPSHNPAFQIHMGAASSPQTPLMAAAAAAASAAASAKRPPQKPPSRPPAPTSNAAAASMAAAYKAANSGSVDLTPAARRNKKRKLPEKQLPDRVAALLPESALYTQLLEFEARVDAALARKKVDIQEALKTPPSLQRTLRIYVFNTFANQAPRTIPPPKNGDPPTWSLKIIGRVLEDGAELDPASVVPKHNPVYPKFSSFFKRVTIALDSSLYPENPLIVWENARSAAPQEGFEVKRKGDKEFLANIRLEMNYNPEKFKLSQPLMEVLGVEVDTRARVIAALWQYIKAKKLQNPSDPSYFMCDPQLKKVFGEDKMRFAMLSQKISQHLAPPPPINLEHKIKLSGNGANSSACYDVLVDVPFPLQKEMTAFLANTEKHKDIEACDEVISASIKKIHEHRRRRAFFLGFSQSPVEFINALIASQSKDLKLVAGEASRNIERERRADFYNQPWVEDAVIRYLNRKPPGGNDGPGAGGS

SEQ ID NO: 539 - DNA, 1548 bp, Zea mays
  misc_feature (61)..(61): n is a, c, g, or t
  misc_feature (91)..(91): n is a, c, g, or t
atgcatcagcagcagcagcagcctcaaacgggcggctcaccggcaacgcccatgacccacnttcgccctccctccctcgccggctcccccntccagggcytyttccacacgccgcccacccacaaccccgccttccagatccacatgggtgcctcgtcctcaccccagactccgctcatggccgccactgcaggatcggccaagcgccccccgcaaaagccccctgtccggcccctggcacccggctcaacctcgtcggccgcagcggcctcggcggctgccgcgtacaaggctgcggccgcggcggcggccgttgccaactctgggggcgtcgacctcacccccgccgcgcggcgcaacaagaagcgcaaactccccgagaagcagctccctgaccgcgtcgccgcgctgctcccagagtccgccctctacacgcagctgctcgagttcgaggcccgcgtggacgccgcgcttgcgcggaagaaggtagacatccaggaggcgctcaagacgccgccctcgctccagcgcacactccgcatctacgtcttcaacaccttcgccaaccaggggcctcgcaccatcccaccgcccaagaatgctgacccgccaacctggtcgctcaagatcattggtcgcgtgctggaggacggcgccgagctggatccttccagtgttgtgcccaagcacaacccagtgtaccccaagttctcccaattcttcaagagggtgactatagcgctggacccctctctgtacccagagaatccgctcatcatctgggagaatgcacggacagctgcccagcaggaagggttcgaggtaaagaggaaaggggataaagagtttgttgcaaacatccggctggagatgaactacaatcctgagaagttcaagctgtcacagccgcttatggaggtgcttggggtggaggtggacactcgcgcacgggtgattgctgccctctggcagtatattaaagcaaagaagcttcagaacccaaatgatccttccttcttcatgtgtgaccctcaattgaagaaggtgtttggggaggacaagctcaagtttgcaatgctgtcacagaggatatctcagcatctgtctgccccgccacccatcaatttggagcacaagattaagctgtcggggaatgaagcgcatagcagtgcttgctatgatgtgctggtggatgttcccttcccgctgcagaaagagatgatggcattccttgccaacacagagaagcacaaggacattgaggcctgcgacgaggtgatatctgcttcgatcaagaagatccatgagcatcgcaggaggagggccttcttcctgggtttcagccagtccccagtggagttcatcaatgctctgatagcttcccagagcaaagatttaaagctggttgctggcgaggcgaataggaacattgagaaagaaagacgtgccgacttctataaccaaccatgggttgaagacgccgttataagatacttgaaccgcaaaccggctaacgagggcctaggtggtggtgctggtggttcttga

SEQ ID NO: 540 - protein, 515 aa, Zea mays
  misc_feature (21)..(21): Xaa can be any naturally occurring amino acid
  misc_feature (31)..(31): Xaa can be any naturally occurring amino acid
  misc_feature (34)..(34): Xaa can be any naturally occurring amino acid
MHQQQQQPQTGGSPATPMTHXRPPSLAGSPXQGXFHTPPTHNPAFQIHMGASSSPQTPLMAATAGSAKRPPQKPPVRPLAPGSTSSAAAASAAAAYKAAAAAAAVANSGGVDLTPAARRNKKRKLPEKQLPDRVAALLPESALYTQLLEFEARVDAALARKKVDIQEALKTPPSLQRTLRIYVFNTFANQGPRTIPPPKNADPPTWSLKIIGRVLEDGAELDPSSVVPKHNPVYPKFSQFFKRVTIALDPSLYPENPLIIWENARTAAQQEGFEVKRKGDKEFVANIRLEMNYNPEKFKLSQPLMEVLGVEVDTRARVIAALWQYIKAKKLQNPNDPSFFMCDPQLKKVFGEDKLKFAMLSQRISQHLSAPPPINLEHKIKLSGNEAHSSACYDVLVDVPFPLQKEMMAFLANTEKHKDIEACDEVISASIKKIHEHRRRRAFFLGFSQSPVEFINALIASQSKDLKLVAGEANRNIEKERRADFYNQPWVEDAVIRYLNRKPANEGLGGGAGGS

SEQ ID NO: 541 - DNA, 1110 bp, Arabidopsis thaliana
atggaggacacgaagccaccattgggaggtaacaacaatcctcagcagcagcagcaacaacaacaacttctctatcaacaccaactacaacaacaacagagacaacaacaaatgcttctattgcagcaattgcaaaaacaacaacagcaacaagcagcaatgtctagattcccgtcgaacatcgacgtgcatctccggccaccggggttgattcagaaccgacccattaatcctccgcctcagcagaatcctacccctaaccctaatttgggacagcagacaccgaattttcaacagcagcagcagcagaatgtatcgagtcagcagatgatgcagcaacaacaacaacagcagcagcagcagaaattgatgaggccattgaatcacatcgagcttcaatgcgcttatcaggacgcttggcgtgtttgtcaccccaattttaaacaacccttctcttctctcgaagatgcttgcgagagattattaccttatcatgtcgtagcagattacgaagcagaagaggatgatagaatccttgattcagacccaacaggccaggccttgtcccgctctcaacaatgggataacaacattgctgcgaaagttgctgaattcacggcaacgtttgagaagcaagcactagcttttaacataataactcgaaagagagctatgggagaattcagatctgaggaaaggttgatggtagaacaagctttgctacaagatgaaaggaaagcgttgattgaactgaaagcagaaatggatagggagaaggctggccgggaggctcaggaggctaagctgcggatggcggctttagctcaagctggacagtctcaatctcatgctgagataatggctcgtaacccattaagggctaatgcggttggaaatcagggcagcaatattcagcttagccacgagatgggagaacagggacgtaacatgaaccctgatgagatgatgaatggatggggaaacaacagtcagagagaggacaaggaaccttcagaagatttcttgaatgatgaggagaatgagaatggagagacaggggaacaagaaaactggcgtgaagcaggagaatttgatttgaatagccggtaa

SEQ ID NO: 542 - protein, 369 aa, Arabidopsis thaliana; identical to SEQ ID NO: 46

SEQ ID NO: 543 - DNA, 1146 bp, Vitis vinifera
atggatgaggcgaacgccaaggcattggcgcagcatcagcagcagctcatgctgcagcaccagcagcagcaacagcagcaacagcttctccttcttcaacagctccagaagcagaagcagcagcatcagcagcagcaacagcagcagcaacagcaacagcagcagcaacagcaacagcagcagcagcaacagcaacagcagcaagcaatctcccggttcccttccaatattgacgcccatttgcgccctccaggcctccaccgccccatctcgctccaaccgcaaaaccccaaccccactcctaaccctaaccctaaccctaaccctaaccctatccccaatgtgcaaaaccctggccccgcaaatccgcagcagcagcagcagaaggtgatgcggcccgggcaccaggtggagctccagatggcgtaccaggacgcgtggcgggtctgccaccctgatttcaaacgtcctttctcttctctcgaggacgcctgcgagaggctactgccttaccatgtggtggcagactatgaagcagaggaggatgatagaatccttgactctgacactacaggccaaatgccgtcccgctctcagcaatgggaccacaatattgctgccaaagttgcagagttcactgccacatttgagaaacaggcccttgccttcaatatcatatcccgcaagagagccattggcgagtttcgatcagaggagaggttgatgattgagcaagcactcctgcaagaggagaaaagagcaatgctggaactgaggacagagattgagtcaagggagaaggctggacgagaggctcatgaggcgaagttgcgtatggcagcaatggttcaggcagagcaagcacgggcagagtcacaggcccatgctgagttgctggctcgagctccaataagggcgagtgcactcgggcctcagggcaatgacctcccaattggccatgatatggcagagcaggaacagggtgtcaacccagatgagatgatgaatggttggggaaacaacacacagagagatgagaaagagccatctgaggatttcttgaacgatgaggagactgaaaatggagacgcaggcatgcaagacgagtggcgtgaagttggagagtttgatctgaacaccagataa

SEQ ID NO: 544 - protein, 381 aa, Vitis vinifera
MDEANAKALAQHQQQLMLQHQQQQQQQQLLLLQQLQKQKQQHQQQQQQQQQQQQQQQQQQQQQQQQQQAISRFPSNIDAHLRPPGLHRPISLQPQNPNPTPNPNPNPNPNPIPNVQNPGPANPQQQQQKVMRPGHQVELQMAYQDAWRVCHPDFKRPFSSLEDACERLLPYHVVADYEAEEDDRILDSDTTGQMPSRSQQWDHNIAAKVAEFTATFEKQALAFNIISRKRAIGEFRSEERLMIEQALLQEEKRAMLELRTEIESREKAGREAHEAKLRMAAMVQAEQARAESQAHAELLARAPIRASALGPQGNDLPIGHDMAEQEQGVNPDEMMNGWGNNTQRDEKEPSEDFLNDEETENGDAGMQDEWREVGEFDLNTR

SEQ ID NO: 545 - DNA, 1203 bp, Ricinus communis
atgacgtcatttctagccttccacagacgccaaagcctgaaaactatcatctccattccgcctcagcagcagcaacatgcgcagcaccagcaacagcttctcttgcttcaacaattgaagcaagcacagcaagcacagcaagcacaacaagcacaaaaacaacagcagcagcagcatcagcaacatcaacaacaacaatcagccgcgatttcacgattcccatccaacattgacgcacacctccatcctccaggtctccatcgccaactcaatcttccgcagcagaaccctaaccctaaccctaaccctaataatcctaatcccaatttgcatcaccatcagcagcagcagcagcagcagcaaggatccaatttagggcaaaatgcgcagcaagtgcaacattctcagcagcagcagcagcatcagcaacagcaacaacaacagaaggggatccgacccccaattaatcaggtggagctccagatggcttatcaggatgcttggcgagtctgccatccagatatcaaacgtccattttcttctcttgaagatgcttgtgaaaggttactgccttaccatgtagtagcagactatgaagcagaagaggatgatagaattcttgactccgacacaacaggtcagatgccatctcgctctcagcagtgggatcacaacattgcagccaaagttgctgaattcactggtacatttgagaaacaggccctggccttcaacataataacccggaagagagctttgggtgaattccggtctgaggagagattgatgattgagcagatgcttctccaggaggagaaacggcttatgttggagttgaaaacagaaatggatgccagggagaaggctggtcgggaggctcagttgagaatggcagccatggttcaggcagagcaagctcgtgcagaatcacatgctcatgctgaaatgatggctcgagcaccaatacgagcaagtgcacttgggtctcaaggcaacaatgttcctattggtcatgacataggagatcaggaacatagtgtaacccctgaacagatgatgaatggctgggggggaaacaatgcacagagagatgagagagaaccttctgaagattttttaaatgatgaagagactgaaaatggagatactggtggccaaggtgagtggcgcgaagttggggaatttgatctgaataccagatga

SEQ ID NO: 546 - protein, 400 aa, Ricinus communis
MTSFLAFHRRQSLKTIISIPPQQQQHAQHQQQLLLLQQLKQAQQAQQAQQAQKQQQQQHQQHQQQQSAAISRFPSNIDAHLHPPGLHRQLNLPQQNPNPNPNPNNPNPNLHHHQQQQQQQQGSNLGQNAQQVQHSQQQQQHQQQQQQQKGIRPPINQVELQMAYQDAWRVCHPDIKRPFSSLEDACERLLPYHVVADYEAEEDDRILDSDTTGQMPSRSQQWDHNIAAKVAEFTGTFEKQALAFNIITRKRALGEFRSEERLMIEQMLLQEEKRLMLELKTEMDAREKAGREAQLRMAAMVQAEQARAESHAHAEMMARAPIRASALGSQGNNVPIGHDIGDQEHSVTPEQMMNGWGGNNAQRDEREPSEDFLNDEETENGDTGGQGEWREVGEFDLNTR

SEQ ID NO: 547 - DNA, 1028 bp, Solanum lycopersicum
agctactcctattgcagcagttccagcgtcagaagcagcagcagcagcaggatgcgatggctcgattcccttcgaacattgatgttcatctccgtcctcaacagctccttcatcgcccccttacccctcttcaatcacagaacccgaattcaaaccctaaccctaaccctagctctagcaataatccgtcaagccagatccccaatctacaaaacccgggtacttcccaacaacaacaacagcagcagcagcagcagaagttgacacgggttgccccggaatcgaaccgggtggagctccagatggcttaccacgacgcttggcgagtttgccatcctgattttaagcgtcctttctcttctcttgaagatgcctgcgaaaggcttctgccttaccatgtggtggcagactatgaagcagaggaggatgataagatcctcgattcagacactagtggccaaatgctctctcgttcacagcagtgggatcacaacattgctgtgaaagtttcagagtttactgcaacatttgagaaacaagtgcttgcgtttaatataatttcccgcaagagagatgttggagaattccgtaccgaggagaaactgatgttagagcagtcactgttgcaagaagagaggaaaagcctgcttgaattgaagacagagatggaggccaggcaaaagatgggtcgagagactcatgatcctaatttgcaaatggcagctcttgttcatgcagaacaagcccgtgctgaatcacaagctcgtgctgagatgatgaaccgagcgccaatacgagctagtgcacttgggcctagggggagcaatattcaaatgggtaatgatgtcggtgagcacggacaggaagttagccctgatgaaatgatcaacggttggggtaacaatggacataaagatgaaaaggaaccatcggaggactttttgaatgatgaagaaactgataatggagatgtaggtactcagagtgagtggcgtggaggtggggagctggatctgaacacaagatga

SEQ ID NO: 548 - protein, 366 aa, Solanum lycopersicum
MDEAKTLAQQQQQLMMQQQQQQQQQLLLLQQFQRQKQQQQQDAMARFPSNIDVHLRPQQLLHRPLTPLQSQNPNSNPNPNPSSSNNPSSQIPNLQNPGTSQQQQQQQQQQKLTRVAPESNRVELQMAYHDAWRVCHPDFKRPFSSLEDACERLLPYHVVADYEAEEDDKILDSDTSGQMLSRSQQWDHNIAVKVSEFTATFEKQVLAFNIISRKRDVGEFRTEEKLMLEQSLLQEERKSLLELKTEMEARQKMGRETHDPNLQMAALVHAEQARAESQARAEMMNRAPIRASALGPRGSNIQMGNDVGEHGQEVSPDEMINGWGNNGHKDEKEPSEDFLNDEETDNGDVGTQSEWRGGGELDLNTR

SEQ ID NO: 549 - DNA, 1071 bp, Sorghum bicolor
atggacgacgcagcgaatcccgcccctccaccgtccacctccactgctgcatccgcggcggccgcggccgcgcagcaccagcagctccagcgccaactcttcctaatgcagcaggcgcagtcccacccgcagcagctgtcgcagcaggccatgtcccgcttcccctccaacatcgacgctcacctccgccccctaggcccggttcgcttccaacagcctcagcagccccagccccagccccagccccagccgtcccactcccagggtccatctcagtcaccgttgcaggccgcgcagcaggcgtcgccccagcagcagcagcaggcggcggcggcgcaggcacaggcacaggtggcgcgggtacgaagccccgagatggagatggcgctgcaggacgccatgcgggtctgcaacccagacgtcaagacgcccttccagtccatcgaggacgttgtcaacaggttattgccttaccatgttgttgccgactatgaggctgaagaagatgacagaatccttgatagtgatacaacaggccagattccttctcgtctgcagcaatgggatcataacattctggtgaagattgctgagttcacgacgacatttgacaagcaagtattggcatataacataatgacaaagaaaagggccattggtgagttcaggtcagaggagcggctcatgctagagcaagccttgttacaggaggaaaagcaggctatgctgggactaagagcagagatggagtcgagagagaaagctggtcgtgaggctgctgaagtgaagatgcgtatggcaatggagcatgctcgtgctgaggcacaagctcactctgagatgttgaatcatggtcctataagggccagtgttgttgcttctcaaggggacaatggtccgagtcatgaaatggtgcaagaacatggtgaagatgggtggagaaattctcagagggatgatgaagagccatctgaggatttcctcaatgatgagaacgaacctgagaatgggaactcagatgggcatgaggactggcgcagatctggggagcttgatctgaactctaggtaa

SEQ ID NO: 550 - protein, 356 aa, Sorghum bicolor
MDDAANPAPPPSTSTAASAAAAAAQHQQLQRQLFLMQQAQSHPQQLSQQAMSRFPSNIDAHLRPLGPVRFQQPQQPQPQPQPQPSHSQGPSQSPLQAAQQASPQQQQQAAAAQAQAQVARVRSPEMEMALQDAMRVCNPDVKTPFQSIEDVVNRLLPYHVVADYEAEEDDRILDSDTTGQIPSRLQQWDHNILVKIAEFTTTFDKQVLAYNIMTKKRAIGEFRSEERLMLEQALLQEEKQAMLGLRAEMESREKAGREAAEVKMRMAMEHARAEAQAHSEMLNHGPIRASVVASQGDNGPSHEMVQEHGEDGWRNSQRDDEEPSEDFLNDENEPENGNSDGHEDWRRSGELDLNSR

SEQ ID NO: 551 - DNA, 1053 bp, Triticum aestivum
atggaggacgccgcgaacgccacccagactacctccaccacctcgtcggtggccgccgtagccgcggcggcccagcaccagcagctccagcgccagctctttctcatgcagcaggctcaggctcaggctcaggcgcaggcccagccccacccgcaggcgcagcagctgtcgcagcaggccatgtcccgcttcccgtccaacatcgacgcccacctccgccccctcggaccgcaccgcttccagcagccggcgccgtcgcagctccaaaccccaccccagccgcactcgcaggggcagccgcacccccagccgtccccgcagcaagcggcgcaggctagggtccggagccccgaggtggagatggcgcttcaggacgccatgcgggtctgcaacccggacatcaagacgcctttccattctctcgaggacgctgttagcaggttattgccttaccatgttgttgctgactacgaggctgaagaagatgacaggatccttgacagcgacgcaactggccagattccctctcgtcttcagcaatgggatcataacattctggtaaaaattgctgagttcacaacaacttttgagaagcaagtgttggcatacaacataatgaccaagaaaagggccattggtgagtttcgatcggaggagcgactcatgctagagcaagctttgttacaggaggagaagcaggcttcgatggaactaagagcagagatagaatctagggagaaagcaggccgcgaggctgctgaagctaagatgcgtatggccatggctgagcatgctcgagtggaagctcaagcacaccctgaggtgattggtcatggccctttgagggccaatgctgctgcttcccaaggcgatgatggtcctagtcatgacatggcacaacaacaggttgaagatggatgggaaaacactcaaagggatgatgatgatccatctgaggatttcctcaatgatgagaatgagccagagaatggaaactctgatatgcaagaggagtggcggcgatcgggggaatttgatctaaactctaggtaa

SEQ ID NO: 552 - protein, 350 aa, Triticum aestivum
MEDAANATQTTSTTSSVAAVAAAAQHQQLQRQLFLMQQAQAQAQAQAQPHPQAQQLSQQAMSRFPSNIDAHLRPLGPHRFQQPAPSQLQTPPQPHSQGQPHPQPSPQQAAQARVRSPEVEMALQDAMRVCNPDIKTPFHSLEDAVSRLLPYHVVADYEAEEDDRILDSDATGQIPSRLQQWDHNILVKIAEFTTTFEKQVLAYNIMTKKRAIGEFRSEERLMLEQALLQEEKQASMELRAEIESREKAGREAAEAKMRMAMAEHARVEAQAHPEVIGHGPLRANAAASQGDDGPSHDMAQQQVEDGWENTQRDDDDPSEDFLNDENEPENGNSDMQEEWRRSGEFDLNSR

SEQ ID NO: 553 - DNA, 1080 bp, Zea mays
atggacgacgccgcgaatcccacccctccaccatccacctccgccgcatccgcggcggccgcggcggcgcaacaccagcagctccagcgccaactcttcctaatgcagcaggcgcagtcccatccgcagcagctgtcgcagcaggccatgtcccgcttcccctccaacatcgacgctcacctccgccctctagggccgcttcgcttccaacagccccagccccagccccagccgtcccactcccagggtccatctcagtcgccgtcgcaggccacgcagcaggcgtcaccccagcagcagcagcagcaggcggcggcggcggcggcagcggcgcaggcacaagcacaggcccaggcccaggcggcacgggtacgaagccccgagatggagatggcgctgcaggacgccatgcgggtctgcaatccggacgtcaagacgcccttccagtccatcgaggacgctgtcaacaggttattaccttaccatgttgttgccgactatgaggctgaagaagatgacaggatccttgatagcgacacaacaggccagatcccttctcgcctgcagcaatgggaccataatattctggtgaagattgctgagttcacgacaacttttgacaagcaagtattggcatataacataatgaccaagaaaagggccatcggtgagttcaggtcggaggagcggctcatgctggagcaagccttattgcaggaggaaaagcaagctatgctgggactgagggcagagatggagtcgagagagaaagctggtcgcgaggctgccgaagtgaagatgcgtttggcaatggagcatgctcgtgctgaggcacaagctcactctgagatgatgaatcatggtcctataagggccagtgctgttgcttcgcaaggggaggatggtccgagtcatgacatggtgcaagaacatggcgaagatgggtggggaaattctcagagggatgatgaagatccatcggaggatttcctcaacgatgagaacgaacctgagaatgggaactcagatgggcaggaggactggcgcagatctggggagtttgatctcaactctaggtaa

SEQ ID NO: 554 - protein, 359 aa, Zea mays
MDDAANPTPPPSTSAASAAAAAAQHQQLQRQLFLMQQAQSHPQQLSQQAMSRFPSNIDAHLRPLGPLRFQQPQPQPQPSHSQGPSQSPSQATQQASPQQQQQQAAAAAAAAQAQAQAQAQAARVRSPEMEMALQDAMRVCNPDVKTPFQSIEDAVNRLLPYHVVADYEAEEDDRILDSDTTGQIPSRLQQWDHNILVKIAEFTTTFDKQVLAYNIMTKKRAIGEFRSEERLMLEQALLQEEKQAMLGLRAEMESREKAGREAAEVKMRLAMEHARAEAQAHSEMMNHGPIRASAVASQGEDGPSHDMVQEHGEDGWGNSQRDDEDPSEDFLNDENEPENGNSDGQEDWRRSGEFDLNSR

SEQ ID NO: 555 - DNA, 1584 bp, Arabidopsis thaliana
atggcgatttcaagtgtgggttttgcttgcagatccttttcccctgttcgtactctccagtctcactgcttatggaagatacggttcaacactgttgctgctgcaattgagacaatggatgagtcagatggttttgccacggacagtgatcgtcaagacaaggtttctgatgaaccaagggatcgtgagtggaaacaactgaattcgaaagatcttggactaagcagctcaatgattgcaaaatccacaagaaaagtgcttaatggccttaaaagcaaaggacatgatgtttaccttgtgggaggctgtgtacgagatcttattctgaagcggacaccgaaagacttcgatatacttacctctgcagaacttagagaggtggttcgaactttcccaagatgtgaaattgttggaagaaggtttcctatatgtcacgtacacattggagatgatttaatagaggtttcgagttttagtacctctgcacagaattcttcgagaaatacgagaactgaatgcaaagaatcgagtggctcagatggtgatgaggactgtatccgtttgaataactgtttgcagcgtgatttcacaattaacgggttgatgtttgatccatatgccaaagtcgtatatgactatttgggaggaatggaagatattagaaaagctaaagttcgaacagtgattcacgctggcacatcttttcaccaggactgtgctcggattcttcgtgcaataagaattgctgcgcgtttaggtttcagaatgtccaaagaaaccgctcattttattaagaacctttccttactagtacaaagacttgacaagggaaggatcttgatggaaatgaattacatgttagcttatggatcagcagaggcttctttgagattgctgtggaaatttgggatacttgaaattcttctaccaattcaggcagcatatcttgcacgcagtggtttcaggagacgtgacaaaaggactaacatgcttctgtctctctttgctaacttggataaattgttagcacctgataggccttgtcacagcagcttatggatagcaatcttggcgtttcacaaagcacttgctgataaacctcgaagtcctatagtggttgctgcgtttagccttgctgttcacaactgtggagatattctagaagctgtggaaatcacaaagaagatcactaggccacacgataaaagcttcttcgagctagtagagcccgaggagaatctcgacttccaaaccctgttggacgaggtcatggatcttgatgcttctatcgaagatgccttaaaccagatgactgatgcgtattttatatcgaaagctatgtcagcttaccctcaagcaccatattccgatttggtctttataccgttgcagctgtaccttagagcaggcagaatcttcgattgtgtgaaaaacgaagagacacgaattggatttgaggccaagcaaggaagcaagatcgagtatggttcgttaaattcaggatattttcccgaaattcggcatgtatttgcgagggttgtgttcgatactgtttttccattaaacctatctcaagaattgtaa

SEQ ID NO: 556 - protein, 527 aa, Arabidopsis thaliana; identical to SEQ ID NO: 48

SEQ ID NO: 557 - DNA, 1626 bp, Arabidopsis thaliana
atgttcaataagctttcttcaatggcgtatggttctttcggcgtctcatcaaaagctctagtctattgccgtccctgctatggctccattagagatctccctttctccctccgaacgtcaacaattggtcattgcggctgtgttggagctatcgcagcacctagaaatgttgtgaaacctcgcaaggaagaaagtcgtgattttagtggagcacggggaagtaataaggataaatcgatgccatggaagaagttagatgctaatgaatttggtattcagaggtcaatgataccagattctacacggatggttctcaataaactcaagaaaaaaggatttcaagtttacctagttggaggttgtgttcgggatcttattctagatagaatccccaaggattttgatgttatcactactgctgaactcaaggaggtacggaaagtatttcccggctgtcaaattgttggaagacgatttccaatatgtcatgtttatgttgatgatattatcatagaggtgtcaagttttagtacttcagcaaggactggtaaagcgcccaataaaagctttagacggcctgcgggatgcgatgagcgggattatattcgttggaagaattgcttacagcgtgattttacagtcaacgggttgatgtttgatccatcggagaatgtagtgtatgactatataggaggagttgaagatttaaggaattctaaagttagaacagtatccgcagcgaatctttcatttgtcgaggatacagctcgcattttacgtgcaattaggattgcagcaaggttaggattcagcttgactaaagacgttgctatttctgtgaaggagctttcttcttcattactgagacttgacccttcaaggattcggatggaaatcaattatatgctggcatatgggtccgcagaagcttctttacggttattatggagatttggcctcatggaaattcttctacctatccaggcatcttatcttgtttcccaagggttccggaggcgtgatggaaggtccaacatgcttctgtcgctatttcgcaaccttgaccgacttgtagcacctgatcgaccatgcagcgagttcctctggattgggatcttagcattccacaaagcattagtcgatcagcctcgggatcccacggtagtagcttccttctgccttgccatctacagtgaagtatctttatcagaagccatcgcaattgcaaggagcaactcaaaacaacacaactcacacttccaagaattgtccagtcctgaaaaggacactgctgactcagagagcaaaatatcgcagcaggtcataaaattagcagagtctataagatcagctgcgcggaaattgaataaccgagactacatagctaacgcaatgagcaaatacccgcaagcaccgggctctgatatggtattcttgtcaagacttatgttggagagagtagagaaaatgtttggaaatgtgagaagaaaaggaaaccaagagagagatgatgtcccaagtttagagcgtaggataaactacaagtctcttgcccttggagactttcatgagacacgtcgtgtttttgctaggattgtctttgataccatttaccctctggcctaa

SEQ ID NO: 558 - protein, 541 aa, Arabidopsis thaliana
MFNKLSSMAYGSFGVSSKALVYCRPCYGSIRDLPFSLRTSTIGHCGCVGAIAAPRNVVKPRKEESRDFSGARGSNKDKSMPWKKLDANEFGIQRSMIPDSTRMVLNKLKKKGFQVYLVGGCVRDLILDRIPKDFDVITTAELKEVRKVFPGCQIVGRRFPICHVYVDDIIIEVSSFSTSARTGKAPNKSFRRPAGCDERDYIRWKNCLQRDFTVNGLMFDPSENVVYDYIGGVEDLRNSKVRTVSAANLSFVEDTARILRAIRIAARLGFSLTKDVAISVKELSSSLLRLDPSRIRMEINYMLAYGSAEASLRLLWRFGLMEILLPIQASYLVSQGFRRRDGRSNMLLSLFRNLDRLVAPDRPCSEFLWIGILAFHKALVDQPRDPTVVASFCLAIYSEVSLSEAIAIARSNSKQHNSHFQELSSPEKDTADSESKISQQVIKLAESIRSAARKLNNRDYIANAMSKYPQAPGSDMVFLSRLMLERVEKMFGNVRRKGNQERDDVPSLERRINYKSLALGDFHETRRVFARIVFDTIYPLA

SEQ ID NO: 559 - DNA, 2646 bp, Arabidopsis thaliana
atggcggttttaagtgtgggtttcttcgcttgcagatcccattttcctgttcttcccctgttttactgtttctcgaaggttcagctcaacactgttgctgctgcaatggagactgtggatgacaaagacagtgatcatcatcatgacaagggttctaataagacgagtaaagcaccagagtggaagaaattgaattcaaaagaccttgggataaccacttctatgatttcaaagcctacacgaatagtgctaaatggccttaagagtaaaggatatgatgtttaccttgtgggaggctgtgtacgcgatcttattttgaagcggacgccaaaagacttcgatatactcacttctgcggaacttagagaggttgttcggagtttctcaagatgtgaaataattggaaaaaaatttcctatatgtcatgtgcacattgggaatgatatgatagaggtttcgagttttagcacctctgctcaaaattctctaagaaacacaagaacgggttctggaaaatctaatggttcctatgacgaggacagtatccgtttcaataactgcttgcagcgtgatttcacaattaatgggttgatgtttgatccatatgccaaagttatatatgactatcttgggggaatagaagacattaaaaaagctaaggtacggacagtgtttcatgctggcacatcatttcaagaggacagtgccaggattcttcgtggaacaagaattgctgcgcgtttaggttttacaatttccaaggaaacagctcatttcttaaagaacctttccttcctagtacaaagactccacaggggaagaatcttgttggaaatgaattacatgttagcgtatggatcagcagaagcttctttacgattgttgtggaaatttgggatactagaaattcttttaccaattcaggcagcatatctcgttcgcactggtttcaagagacgcgacaaaaggagtaacttgcttctgtctctcttcggaaatttggataaattgttggctcctgataaaccttgccacagcagcttatggctaacaatcttggctcttcacaaagcacttgctgatcaacctcgatatccttcagtggtagccgcgtttagccttgctgtccacaatggtggagatgttttagaagctgtaaaaaataccaggaaagtcacaaagccacataatagaagcttctttgagctactggagccagaggaaatggactcccaaaccttgttggatgaagtcatggattttgattcatctatcaaagaagccttgggacagatgactgatgggaggtttatttccaaggctatggcagcgtaccctcaggccccatattccgatatggttttcataccgttgcaattgtacctagatgcaagacgaatattcgagtgtgtgaaagaaaatgggcagaagggatttgtgcctaagcaagacagtaagcgagagccagaagatgatttggagaccaaaccgattctgaagaaacataaggaaaattccgaggaggagaacaaggagcagatcaaaggaacggtcgagttgttggagacaaaatctgatcaggctccagtgaaggagacagtggaaggacttgatgaaactcccgattctgttgaggtacctaagaagtatatgtctggtcttttgattcgttgctttccctcaagaaaaaagacgctctatgtttgctgtctccctcgcgacactaaaatgccagatatcatcgatttcttcaaagatgttggacaagttgttagtgttcaacttactacaaaacgcaacggtttgcgtttgtccactggcttcgttgagtttgcttctgctaacgaagcaaagaaggcgctggatatgaagaatggtgaatatttgtgtggtaataagcttattcttggcatggctagctgcgaaaatattgcacaacccaagtacgaagactacattcaacaagaaagccttccgattgaagaagaggagacacctcccaaaattgttcagagtggcgctaacacacttggctgttccattcaggcagctgctttttccatgactgatattttatccttccacttttacagactcgatttcttcaatgatgttggagaagttgttagtgttcgacttattgtaagccccgagagtaagcatgtgggctatggctttgttgagtttgcttctccttgcttagcaaacatggcgctggaaaagaagaatggtgaatatttgcacgatcataagatttttcttggtgtggctaagacagctccgtaccctccacgaatcaagtacaaccttgcagagaagctttggtacgaagactatcttctacgagatagccttctgatagaagaagatgagacagtggaaggacttgatgaaactcctagttgtgttgaggcagttgccttaagagaaaaggtgctcattattgcgcatgtccctcgccgaacaaaaatatcacatatcatcgatttcttcaaagatgctggacaagttgttaatgtccgacttattgtagaccaaaagggcaagccttttggccgtggctttgttgagtttacttctgctgacgaagcaaagaaggtcagattagtttatagtaatgatgaaaagtattttactagtcattag

SEQ ID NO: 560 - protein, 881 aa, Arabidopsis thaliana
MAVLSVGFFACRSHFPVLPLFYCFSKVQLNTVAAAMETVDDKDSDHHHDKGSNKTSKAPEWKKLNSKDLGITTSMISKPTRIVLNGLKSKGYDVYLVGGCVRDLILKRTPKDFDILTSAELREVVRSFSRCEIIGKKFPICHVHIGNDMIEVSSFSTSAQNSLRNTRTGSGKSNGSYDEDSIRFNNCLQRDFTINGLMFDPYAKVIYDYLGGIEDIKKAKVRTVFHAGTSFQEDSARILRGTRIAARLGFTISKETAHFLKNLSFLVQRLHRGRILLEMNYMLAYGSAEASLRLLWKFGILEILLPIQAAYLVRTGFKRRDKRSNLLLSLFGNLDKLLAPDKPCHSSLWLTILALHKALADQPRYPSVVAAFSLAVHNGGDVLEAVKNTRKVTKPHNRSFFELLEPEEMDSQTLLDEVMDFDSSIKEALGQMTDGRFISKAMAAYPQAPYSDMVFIPLQLYLDARRIFECVKENGQKGFVPKQDSKREPEDDLETKPILKKHKENSEEENKEQIKGTVELLETKSDQAPVKETVEGLDETPDSVEVPKKYMSGLLIRCFPSRKKTLYVCCLPRDTKMPDIIDFFKDVGQVVSVQLTTKRNGLRLSTGFVEFASANEAKKALDMKNGEYLCGNKLILGMASCENIAQPKYEDYIQQESLPIEEEETPPKIVQSGANTLGCSIQAAAFSMTDILSFHFYRLDFFNDVGEVVSVRLIVSPESKHVGYGFVEFASPCLANMALEKKNGEYLHDHKIFLGVAKTAPYPPRIKYNLAEKLWYEDYLLRDSLLIEEDETVEGLDETPSCVEAVALREKVLIIAHVPRRTKISHIIDFFKDAGQVVNVRLIVDQKGKPFGRGFVEFTSADEAKKVRLVYSNDEKYFTSH

SEQ ID NO: 561 - DNA, 1503 bp, Medicago truncatula
atggcaatttcgaccttaaaattagtctgcaaacccaatcttcttcatcttcgtcctatcccatcccaatgtgtccgcaaggttgtaccaagatccgtaccttctgttgagccagaggagttaaataagaaggcaccggcatggaagaagatgaattcaaaagagcttggatttcgaaattccatgattgctagtccaattaaaaaggttctcaacatgttgaagaaaaagggaggttgtgtccgggacatgatactaaggcaaacaccaaaagattttgatattttaacttcagcggatcttaaagaggtgatgagaacattttcatggtgtgagatagttggtaaaaggttcccaatatgtcacgttcatatggatggtatcatcgttgaggtttcaagttttaacactgccaaacgcaagcctggcagacacttcgctcatgatattgaggcacccaagggatttgacaaggaggactatcttcgttggaggaattgtgtgaatagagattttacaattaacgggttcatgtttgatccatttgcaaaaattgtatatgattacatgggaggaatggaagatattataaaagctaaagtccgaactatggttcctgcagctacttcttttcaagaggattgtgctcgcattcttcgtgcaattagaattgctgctcgcttggggtttagtatttcaactgaaaccgctcgttctgttaaacatctttcatattcaatattaagacttgataagggtaggctcctgatggaaatgaattatatgctagcatatggatctggtgaggcttctttgaggctattatggaaatttggacttctagatattcttcttccctttcaggctctttactttgttcgtcatggatttcgaagacgggacaaaagaaccaatatgcttttgtctttgttcttcaatttggataaacttttggctcctaacagtccgtgtcatagcagcttatgggttggtatccttgcattgcataaatctttaagtgatcaaccgaggaatcccttggtgattgctgcatttagccttgctgttcataatggtggaaatttgttggaagcagtagacatagctaggaggataaacaaaccacacgacatcagatttcctgaattatcagatccttgcgatctgaatgcaaaggctttggaaaatgagattctggatcttgtagagtctgttaaagtgtcactgttgcagatgacatctaggcactcggtagctcgagctatggttgactatccacaagcccctcattcagacatggtgttcatcccattaggaatgtacctaaaagctctaagcatttttgactgtctgaaagtaagttcttgcaagaaattcttgtccaagaaaagcagaaaaattgattacgaatccttagctcgtggtgacctgccagaaatacgacacttgtttgcaagggttgtatttgacactgtatatccactacaccttggtcagtcctaa

SEQ ID NO: 562 - protein, 500 aa, Medicago truncatula
MAISTLKLVCKPNLLHLRPIPSQCVRKVVPRSVPSVEPEELNKKAPAWKKMNSKELGFRNSMIASPIKKVLNMLKKKGGCVRDMILRQTPKDFDILTSADLKEVMRTFSWCEIVGKRFPICHVHMDGIIVEVSSFNTAKRKPGRHFAHDIEAPKGFDKEDYLRWRNCVNRDFTINGFMFDPFAKIVYDYMGGMEDIIKAKVRTMVPAATSFQEDCARILRAIRIAARLGFSISTETARSVKHLSYSILRLDKGRLLMEMNYMLAYGSGEASLRLLWKFGLLDILLPFQALYFVRHGFRRRDKRTNMLLSLFFNLDKLLAPNSPCHSSLWVGILALHKSLSDQPRNPLVIAAFSLAVHNGGNLLEAVDIARRINKPHDIRFPELSDPCDLNAKALENEILDLVESVKVSLLQMTSRHSVARAMVDYPQAPHSDMVFIPLGMYLKALSIFDCLKVSSCKKFLSKKSRKIDYESLARGDLPEIRHLFARVVFDTVYPLHLGQS

SEQ ID NO: 563 - DNA, 1629 bp, Oryza sativa
atggcgctgcgcacgccggagctgcgcttcgccgccgcggcggggctcggggcgctctcgcgcccatcccgcgtcgcgccgtccccgctcgccgcgctggcggcgccgcgccggcgcaggcgccgctccccgtcgccctcccccgcgccctccgactccgactccaaccccgcctcctccgcccccgcgaacgccggtggggcggcggcggcggcggaggcgccggagtggaagaaggtgagcgcgaagcggttcgggatcaaggactccatgatccccgacgaggcctggaacgtcctccaccgcctccgcagcagaggatatgatgtctacctggttggtggttgtgttcgagatctcataatgaagaaaaccccaaaagattttgacataataaccacagctgatcttaggcaggtgaaagacactttctcaggatcagctgttatagtaggaaggcggttcccaatatgtcatgtatatgagaacaattcaattgttgaggtatcaagttttaacacttatgcacgagggtcaactagcaatcaaatttacacgtccaagagcccccattgtagcaaaaatgattatatccgatggaaaaattgccaagggagggacttcactataaacgggttaatgttcaatccatatgcagaaaagatctacgactacttcggaggaatcgaggatattaagaaagctaaggttcgtaccgtgattccagctggcacatcattccaggaggactgtgctcgtattctacgtgcaatcagaattgcagctcgtttagggttcaactttccaaaagaaactgcttattatgtgcgaactcttgcctgctctgtggcaagacttgataagggaagaatactcatggagatcaactatatgcttgcttatggttcagctgaagcttctttaaggttgctttggagattcggtcttcttgaacacctgctgccttttcaggcagcatatttttcttcaactcgttttaagaggaaggataaaggaactaacatgctactggtcttattttctaaattggataattttcttgctcctaacaggccatgccataatagtttgtggataagtattttagcacttcatgaagcattagtacgccaaccgcgtgatcctttagtggtagctacttttgccctagctctataccttggaggtgatatgtcattggcactagatattggaaaatcaatcaaccgtcaacataataccggattttcagagctattagaaccccaagtctgggatgataagcatttggtaggcgaggtgcaaagcctagctgtctcaatgcggcgggcattaactgaaatgactgatgaatattttgttgcaaatgctatggcaaaaattcctcaggcaccatcctcagatcttgtattcatcccactacaagcctacctaaaggttctcaaattaattgaatgtgttcaacatgggaaaaaggagcatggctatgaaccgaagagagatggaaatattgattatcatgatctatcttatggtacacctgcagaagtaagaaatgtctttacactggtcgtcttcaacacattatacccctcaaatacggagaatcagcaggatgtcagctcttga

SEQ ID NO: 564 - protein, 542 aa, Oryza sativa
MALRTPELRFAAAAGLGALSRPSRVAPSPLAALAAPRRRRRRSPSPSPAPSDSDSNPASSAPANAGGAAAAAEAPEWKKVSAKRFGIKDSMIPDEAWNVLHRLRSRGYDVYLVGGCVRDLIMKKTPKDFDIITTADLRQVKDTFSGSAVIVGRRFPICHVYENNSIVEVSSFNTYARGSTSNQIYTSKSPHCSKNDYIRWKNCQGRDFTINGLMFNPYAEKIYDYFGGIEDIKKAKVRTVIPAGTSFQEDCARILRAIRIAARLGFNFPKETAYYVRTLACSVARLDKGRILMEINYMLAYGSAEASLRLLWRFGLLEHLLPFQAAYFSSTRFKRKDKGTNMLLVLFSKLDNFLAPNRPCHNSLWISILALHEALVRQPRDPLVVATFALALYLGGDMSLALDIGKSINRQHNTGFSELLEPQVWDDKHLVGEVQSLAVSMRRALTEMTDEYFVANAMAKIPQAPSSDLVFIPLQAYLKVLKLIECVQHGKKEHGYEPKRDGNIDYHDLSYGTPAEVRNVFTLVVFNTLYPSNTENQQDVSS

SEQ ID NO: 565 - DNA, 1518 bp, Oryza sativa
atgacgacgccacgacggcgcgctgacccatcgcccccgcctgctcgccgcctcctccaccgcctcggctccgcggcctccggtctgcagacgctggcgtacagctcgaagaaggaaggcggcggcggcgacatgggcccacgcaacggcggttcctcttctaatagaagaccaggatttgttgattcttcttcatggagatattttgactcgagggttgttggtattactagaggggatatacctcgccatgcctggactgtcctacacatgctaaaacgaaaagggtttgcagcttatcttgttgggggatgcgtgagagatttgctactgaaaagggcacctaaagattttgatgtgattactaccgcaagcctccagcagattaagaaaatggttttccaacgatgtataattattggcaaacgctttccaatatgccagcttaatatgtatggcacaaaaattgaggtttctagctttagcacgaatgcaaatcatgtgaaaggaagtaaaaatataggatgttcagaggagtttaaacgttatgatgagggggatattcttctctggcagaattctatgaaaagagactttacaataaacagcttattctttaatccatttaactttaagatttatgattatgtgaatggagtaagggatattagcaaaaacaaggtgtctacagtgattcctgcccgtgtttcattcaaggaagaccctgccaggattttgcgtggcttgagaattgctgctcgccttggttttgagttctccagtgaaacttctgctgcaatacgggaactttctttgtccataacagatattgacaaggcaagattaatgatggaattgaattatttattgtcttatggggcagcagcttcttctcttaggttacttagaaaatatggacttctcgattttttgctgcctttccaggcagcatatatgtcggatcagatgaaggataaatcaaatgacacagatttaatgctcatgaaactactggctaatcttgataaattactctctgctgatcagccatgcccctcctgtttgtggttagcactgttgacatttcacagtgcattggtaaattctccacatgatgcccaggtaatcagggcttttgctgcactaatgtattttggatcatgggagggcgcagtcaacttcttgaatcaagacattggagcaccagccccgtttattccagaaacactagggccttctcggagcaaactggagaatctcatggaacaaacatcacatttagcatcactagtcaagtcgtcagttgatacgttgacatctatagatgctctccaacaatcactggccaaatactcaaaggcttcacaagtttcaggactggtgcttgtatctagcagagagagggagagagtgttgagaatatttgagggccttgatactgacttaacttcatatgaagggacaagagggatgcaggaaattgattataagttactgaaggatgggcaccctgtgtga

SEQ ID NO: 566 - protein, 505 aa, Oryza sativa
MTTPRRRADPSPPPARRLLHRLGSAASGLQTLAYSSKKEGGGGDMGPRNGGSSSNRRPGFVDSSSWRYFDSRVVGITRGDIPRHAWTVLHMLKRKGFAAYLVGGCVRDLLLKRAPKDFDVITTASLQQIKKMVFQRCIIIGKRFPICQLNMYGTKIEVSSFSTNANHVKGSKNIGCSEEFKRYDEGDILLWQNSMKRDFTINSLFFNPFNFKIYDYVNGVRDISKNKVSTVIPARVSFKEDPARILRGLRIAARLGFEFSSETSAAIRELSLSITDIDKARLMMELNYLLSYGAAASSLRLLRKYGLLDFLLPFQAAYMSDQMKDKSNDTDLMLMKLLANLDKLLSADQPCPSCLWLALLTFHSALVNSPHDAQVIRAFAALMYFGSWEGAVNFLNQDIGAPAPFIPETLGPSRSKLENLMEQTSHLASLVKSSVDTLTSIDALQQSLAKYSKASQVSGLVLVSSRERERVLRIFEGLDTDLTSYEGTRGMQEIDYKLLKDGHPV

SEQ ID NO: 567 - DNA, 1752 bp, Physcomitrella patens
atgctaagtgaggcaattgcgatgcaaggctcagtggcgacgagagcggctcttcttcgtaactctttccattgcctccgatctctcaactgtggagagtttcgatccagaagtctggctcccagctccagcgagcttctccgcagttcagtcgagattttcaggagtcaagttgcagaattcgctccatattctactgcagtaccagcaggaaaaccaattcaggtgcaactgcggattttaaagaaagatgagcatggactacgggacaaacttattccagcttcgtcctggcgcgttctcactcggctacttgatgcagggtacaggagctaccttgttggcggcagtgtacgtgatatgttggtaaagcaggtccccaaagattttgatatcctcaccacagcagaaccaaagcaggtcaaggcggctttttctggtcggtgcattattgttgggagacgatttcctgtatgccatgttacctcgttgaacacagttgttgaggtttcaagcttcagcacaaattcgggaaatatcaagaggattacgtatgaacctgttgtcggaactgagggatggagtgaggacgatttctcccgatgggacaattccctgcgaagagatttcactgtcaatgggatcatgtatgacccatttaaatgtatcatatatgactacgttggtggcttacgagatctgaggagatgcaagattcggactgttatccctgcactcgagtcttttgaagaggattcagcaagaattttaagggcaattcgtattgcggcccgtctagaattttcctttgcaaccagcactgcaaatgcaatcagacaattaaaatcgtccatattgacattgaacaagacaagattgcagttggaagtgaacacaatgatggcatatggttcttcagagcgttctgtcagactgttgtggagatatggtgtccttgagtacttgcttccctttcaggcaaggcaacattttggtcttcttgctcgatatttctcaaatacaaatcttaagcgccaggcacgtcggtcagatattcttttgataatttttaaagcacaatccgtctgtttagtaatctacctcgttttctttcgttctgcatttgtagctattcagaagctgcttgcgaatttggacaaagttacggctccaaatcgtccttgtcatggtggactttgggttgccattcttgcatttcatcttgctttggtcgaaagaccttggagtcttactgtggggcctactgttgcattggctttgtcattcggcactggcttggagaaggccataactcaagtacaaaaattgtgtgacgctgttgacaagaacggtaaacatctgtggaatgatcaattcaggtcatgtgtaaaggagatggatgaagtagtcattttaaacgattgtcaaagttttgtggatttgtgcctcaacaatgtggctcaacttcacagcgctgcagcgacatgcaaggtgatgcaggaattgaacatttcaagtcctccttcagattggggcgttgtctccaaaccctatttttacaaggcaaaccacctattcaatagagctctaacttctaattcagatgattttccagatattgttcatgatacatacaaaggtgtacttatgaacagctccttttccacaaatggaggtatagaggatttaggtaatgttttttctcatgttgtattgagcaccttatttccttcagtttcgagttctctgtaa

SEQ ID NO: 568 - protein, 583 aa, Physcomitrella patens
MLSEAIAMQGSVATRAALLRNSFHCLRSLNCGEFRSRSLAPSSSELLRSSVEIFRSQVAEFAPYSTAVPAGKPIQVQLRILKKDEHGLRDKLIPASSWRVLTRLLDAGYRSYLVGGSVRDMLVKQVPKDFDILTTAEPKQVKAAFSGRCIIVGRRFPVCHVTSLNTVVEVSSFSTNSGNIKRITYEPVVGTEGWSEDDFSRWDNSLRRDFTVNGIMYDPFKCIIYDYVGGLRDLRRCKIRTVIPALESFEEDSARILRAIRIAARLEFSFATSTANAIRQLKSSILTLNKTRLQLEVNTMMAYGSSERSVRLLWRYGVLEYLLPFQARQHFGLLARYFSNTNLKRQARRSDILLIIFKAQSVCLVIYLVFFRSAFVAIQKLLANLDKVTAPNRPCHGGLWVAILAFHLALVERPWSLTVGPTVALALSFGTGLEKAITQVQKLCDAVDKNGKHLWNDQFRSCVKEMDEVVILNDCQSFVDLCLNNVAQLHSAAATCKVMQELNISSPPSDWGVVSKPYFYKANHLFNRALTSNSDDFPDIVHDTYKGVLMNSSFSTNGGIEDLGNVFSHVVLSTLFPSVSSSL

SEQ ID NO: 569 - DNA, 1548 bp, Populus trichocarpa
atggcaatttcaagcttaagctttgcttgtagacccggttttcctcttaggccatctctttttcaccgcattcaaaaagttcggttcagctcagttgcagcaattgaaacccttgatgttcaagagaatgttatcaaaggcaacagtcgaaacttgggggactgtaaggcgccggagtggaagaaattgagttccaaggaacttggactcagtaattcattgatttcaatgcctacaaagaaggtccttaatgggcttaagaaaaatggatatgaggtttatctcgtgggaggttgtgtccgggatcttattttaaagagaataccaaaggattttgatataatcacatcagctgagcttaaagaggtagtaaggacattttcacattgtgaaatagttggcaaatggtttcccatatgtcacgtgcatgttggggatactattgtggaggtttcgagttttagcaccacaggacggaagttcaaggtggatttgagaaatgacatcatttgtcccattgattgtgatgagaaggattatgttcgttggaagaattgtttgcagagggacttcacaataaatgggttgatgtttgatccatataaaagaatagtgtacgattatatgggaggtctggaagatattaaaaaggctaaagtgcgaactgtgatcccagctggtatttcttttcaagaggactgtgctcgcattctgcgtgcagtaagaattgctgctcgtttaggattccgttttacaagggaaacagctcactttgtaaaaaatctttctcgcttgttattaagacttgacaagccaagaatcatgatggagatgaactacatgctagcatatggttctgctgaagcttctttgaggatattatggaaatttggacttcttgaactacttctgcccatccaggcagcatattttgttcgtgatggttttaagagacgggataagagaagtaacatgcttctgtgtctgttttctaacttggataaactccttgcacctgataggccatgccacagcagcctatgggttggaatcttagcattccataaagcattagctgaccaaccaagggatcctatggtagtggcagcattttgtctagctgttcacaatggtggggatattttaggaggagtaaacatggcaaggaagatcaccaagccacatgacatcagctttcatgagttaacgaaacctcaggatctggactctaagatgctgattgatgaggttgtggattttgctgcatctgttaaacaagttttaaattggatgaccgatgagtattatgtttcactggcaatggcagagtaccctcaagcaccatattcagatttggtattctttccgttggcagtgtatttaagagtgtgccggatttttgagtgctcaagagatggcccggaaaaaggttttctgccaaagcaaggtagaaagatcgattacgagatgttgggtttgggaggcctgcaggaagttcggcatacttttgcgagggttgtttttgatactgtgtacccggttaattaa

SEQ ID NO: 570 - protein, 515 aa, Populus trichocarpa
MAISSLSFACRPGFPLRPSLFHRIQKVRFSSVAAIETLDVQENVIKGNSRNLGDCKAPEWKKLSSKELGLSNSLISMPTKKVLNGLKKNGYEVYLVGGCVRDLILKRIPKDFDIITSAELKEVVRTFSHCEIVGKWFPICHVHVGDTIVEVSSFSTTGRKFKVDLRNDIICPIDCDEKDYVRWKNCLQRDFTINGLMFDPYKRIVYDYMGGLEDIKKAKVRTVIPAGISFQEDCARILRAVRIAARLGFRFTRETAHFVKNLSRLLLRLDKPRIMMEMNYMLAYGSAEASLRILWKFGLLELLLPIQAAYFVRDGFKRRDKRSNMLLCLFSNLDKLLAPDRPCHSSLWVGILAFHKALADQPRDPMVVAAFCLAVHNGGDILGGVNMARKITKPHDISFHELTKPQDLDSKMLIDEVVDFAASVKQVLNWMTDEYYVSLAMAEYPQAPYSDLVFFPLAVYLRVCRIFECSRDGPEKGFLPKQGRKIDYEMLGLGGLQEVRHTFARVVFDTVYPVN

SEQ ID NO: 571 - DNA, 1446 bp, Populus trichocarpa
atggtttttgtttcattgttttcttgcagattggagttttctttttcaggggatcctaaggcgctggagtggaagaaatggaattccaaggaacttggaatcagtaattcaacgatttcaaggcctacaaagaaggttcttgatggacttaagaaaaatggatatgaggtttatctggtgggaggctgtgtccgggaccttattttaaagagaacaccgaaggattttgatataatcacatcagctgagcttaaagaggtagtaaggacatttccgcagtgtataatagttggcaagcggtttcccatatgtcacgtgcacgttggggatactattgttgaggtttcgagttttagcaccacgggaccgaagttcaggttggatttgagcaatggcatcagtcctcccattgattgcgatgagaaggattatgttcgttggaagaattgtttgcggcgagacttaacaataaatgggttgatgtttgatccatataaaagaatagtgtatgactatgtgggaggtctggaagatattaaaaaggctaaagtgcggactgtggtcccagctagtacttcctttcaagaggactgtgctcgcattctgcgtgcagtaagaattgctgctcgtttaggattccgttttacaagggaaacagctcactttatcaaaaacctttctcgctcgttattaagacttgacaatcaaaggatcatgatggagatgaactacatgctagcatatggttctgctgaagcttctttgaggatattatggaaatttggacttcttgaacttcttctgcccttccaggcagcatactttgttcgtgatggatttaagagacaggacaagagatctaacatgcttttgtgtctgttttctaacttggataaacatcttgcacctgataggccatgccacaacagcttatgggttggaatcttagcgtttcataaagcattatctgaccaaccaagggatcctatggtggttgcagcattttgtcttgctgtccacaatggtggagatattttaggaggggtaaaaatggtgaagaagttcaccaagccccatgatgttagcttccatgagttatccgaacctcagaatcttaactctgaagcactggttgatgaggttgtggatttcgcagcgtctgttaaacaagttctatattggatgaccgatgagtattgtgtttcacaggcaatggcagagtaccctcaagcaccatgttcagatttggtattctttccattggcagtgtatttaaaagtgtgcaggatttttgagtgttcaagagagggctcacagaaagtatttatgccaaagcaaggtagaaagattaattatgagatgttggctttgggaagcctgcaagaagttcggcatacttttgcgagggttgtctttgatactgtgttcccgctcaatttaacctaa

SEQ ID NO: 572 - protein, 481 aa, Populus trichocarpa
MVFVSLFSCRLEFSFSGDPKALEWKKWNSKELGISNSTISRPTKKVLDGLKKNGYEVYLVGGCVRDLILKRTPKDFDIITSAELKEVVRTFPQCIIVGKRFPICHVHVGDTIVEVSSFSTTGPKFRLDLSNGISPPIDCDEKDYVRWKNCLRRDLTINGLMFDPYKRIVYDYVGGLEDIKKAKVRTVVPASTSFQEDCARILRAVRIAARLGFRFTRETAHFIKNLSRSLLRLDNQRIMMEMNYMLAYGSAEASLRILWKFGLLELLLPFQAAYFVRDGFKRQDKRSNMLLCLFSNLDKHLAPDRPCHNSLWVGILAFHKALSDQPRDPMVVAAFCLAVHNGGDILGGVKMVKKFTKPHDVSFHELSEPQNLNSEALVDEVVDFAASVKQVLYWMTDEYCVSQAMAEYPQAPCSDLVFFPLAVYLKVCRIFECSREGSQKVFMPKQGRKINYEMLALGSLQEVRHTFARVVFDTVFPLNLT

SEQ ID NO: 573 - DNA, 1687 bp, Vitis vinifera
atggcgattgctgttcttggattttcctgtagaagttacctcactttccgtcgtcctctcgtctactgcgttcacaaggttcgacaccgcagcaatgttgcaactgttgaatcgcctcctgaaccagtgggtgttacgaaggaagaagaacctcattgggctacttctgatggaagaggtaatggtgcttctaaggcacctgaatggaagaagttgaattctaaagacctcgggattaggacgtcgatgattgcaaagcccacaagatatgttttaaatggacttaaaaaaaaaggatatgaagtgtaccttgttggaggttgtgtacgggaccttatcctgaagagaactcctaaagactttgacatcataacttcagctgaacttaaggaggtactgagagcatttccccgatgtgaagtagttggaaagcgatttcccatatgccatgtgcatgtcaatgataccattgttgaggtttcaagttttagcacttctggaaagagaaccggtaggaaacttgattatattctcagaagacctcctgattgtgatgatcatgattatattcgctggaggaattgtctacagcgggactttactattaatgggttgatgtttgatccttacacaaagatagtgtatgactatatgggtgggatgcaagatatcaaaaaagctaaagtacggactgtaatccctgctaatatttcttttgtggaggattgcgctcgcattttgcgtggggttagaattgcagcacgtttagggtttcgtttcactaaagatatagctcattctgtaagagagttatcttgctcagtgttaagacttgataagggaaggatactcatggaaatgaattacatgctagcttatgggtccgcagaagcttccttgaggttattatggaaatttggactcctggagatacttctacccatacaagcagcatatcttgtttcccaaggttttcgaagacgtgatcagagatcaaacatgcttttgtctttgttttcaaacctggatagacttgtggcacctgatcggccatgccataatagcttatggattggtatgttagcatttcataaggccttggttgaccaacctcggcaccccatggttgttgcagcattcagccttgctgtgcacaatggtggatccttgtcggaagcggtggaaattgcaaggagaatctcccaacctcatgaccagagcttcagtgaattattagaacctcaggatctagactcggatgaatccttgatagacgagatcatggatcttgcagcatcggtgaaatctgcattgatgaagatgacagatgaacattttgtttcccaagcaatgagcaaatacccacgagcaccatactcagatctggtttttatctcattggcatcattcctaagagcatctaagatctttcagtgcgtacaagggggtgctgagaagggattcgtaccaaaacaagggagtaggattgactacgaattcttagcattgggaagccttcgtgaggttcggcatgtgtttgcaaggatcgtttttgacaccgtttaccctctaagcctcaacacagaggacaattttgtaaaccaaaattcttagtcaattaatattatggagcaaagcttgtctcaaatctcatattttttttataaatcaaatgttataatattaa

SEQ ID NO: 574 - protein, 537 aa, Vitis vinifera
MAIAVLGFSCRSYLTFRRPLVYCVHKVRHRSNVATVESPPEPVGVTKEEEPHWATSDGRGNGASKAPEWKKLNSKDLGIRTSMIAKPTRYVLNGLKKKGYEVYLVGGCVRDLILKRTPKDFDIITSAELKEVLRAFPRCEVVGKRFPICHVHVNDTIVEVSSFSTSGKRTGRKLDYILRRPPDCDDHDYIRWRNCLQRDFTINGLMFDPYTKIVYDYMGGMQDIKKAKVRTVIPANISFVEDCARILRGVRIAARLGFRFTKDIAHSVRELSCSVLRLDKGRILMEMNYMLAYGSAEASLRLLWKFGLLEILLPIQAAYLVSQGFRRRDQRSNMLLSLFSNLDRLVAPDRPCHNSLWIGMLAFHKALVDQPRHPMVVAAFSLAVHNGGSLSEAVEIARRISQPHDQSFSELLEPQDLDSDESLIDEIMDLAASVKSALMKMTDEHFVSQAMSKYPRAPYSDLVFISLASFLRASKIFQCVQGGAEKGFVPKQGSRIDYEFLALGSLREVRHVFARIVFDTVYPLSLNTEDNFVNQNS

SEQ ID NO: 575 - DNA, 785 bp, Zea mays
atggccctgcgctccccggatctgcggtggctcggatcgctcacgaggcccggccgccttgcaccatccccactcgccgcgctcgcctccccacggcgccgccgccgcgcaccgtccccttcgccctcgccctccgactcctccaccccatctaccgcccctacatccgacagtgggccgggagcggaggggatggaggggctggagtggaagaagatcagtgccaagaggttcgggatcaaggagtccatgatcccccccgaggcctgaaacgtactacaccgcctccgcagcagaggatatgatgtgtaccttgttggtggttgtgttcgagatctcataatgaaaaagacgccaaaggatttcgacataataacaacagctgatcttaggcaggtgaaagacactttcttaggatcagctgttatagtaggaaggcgttttcccatatgtcatgtacatgagaacaattccatcgttgaggtgtcaagttttaatacttgtgcaaggggatcaagtggtagccagatttacaattcaaagagccaaaattgtagcaagaatgattttgttcgctggaagaactgccaaaggagggacttcacaattaatgggttaatgtttaacccatattcagaaaagatctatgattacttgagaggcattgaagatattaagaaagctaaggtccgtactgtaattcctgctggcacttcgtttcaagaggactgtgcccgtattctacgtgcaatcagaattgcagctcgttttagggttcattttcc

SEQ ID NO: 576 - protein, 261 aa, Zea mays
MALRSPDLRWLGSLTRPGRLAPSPLAALASPRRRRRAPSPSPSPSDSSTPSTAPTSDSGPGAEGMEGLEWKKISAKRFGIKESMIPPEANVLHRLRSRGYDVYLVGGCVRDLIMKKTPKDFDIITTADLRQVKDTFLGSAVIVGRRFPICHVHENNSIVEVSSFNTCARGSSGSQIYNSKSQNCSKNDFVRWKNCQRRDFTINGLMFNPYSEKIYDYLRGIEDIKKAKVRTVIPAGTSFQEDCARILRAIRIAARFRVHFP

SEQ ID NO: 577 - DNA, 1416 bp, Zea mays
atggaggggctggagtggaagaagatcagtgccaagaggttcgggatcaaggagtccatgatcccccccgaggcctggaacgtactacaccgcctccgcagcagaggatatgatgtgtaccttgttggtggttgtgttcgagatctcataatgaaaaagacgccaaaggatttcgacataataacaacagctgatcttaggcaggtgaaagacactttcttaggatcagctgttatagtaggaaggcgttttcccatatgtcatgtacatgagaacaattccatcgttgaggtgtcaagttttaatacttgtgcaaggggatcaagtggtagccagatttacaattcaaagagccaaaattgtagcaagaatgattttgttcgctggaagaactgccaaaggagggacttcacaattaatgggttaatgtttaacccatattcagaaaagatctatgattacttgggaggcattgaagatattaagaaagctaaggtccgtactgtaattcctgctggcacttcgtttcaggaggactgtgcccgtattctacgtgcaatcagaattgcagctcgtttagggttcagcttccccaaagaaacagcttattatgtgagaacacttgcttgctcagtggcaagacttgataaggcaaggatactcatggagatgaactatatgcttgcttatggttcagctgaagcttctttgaggttgttgtggaggtttggcctccttgaacatttgttgccctttcaggcagcatatttctcttcgactcgttttaagaggaaggataaaggaactaatatgctacttgtcttattttctaagctggataattttcttgcaccgaacaggccatgtcacaatagtctatggataagccttttagcttttcatgaagcattggcacgcaaaccatgtgatcctttgatagtggctacttttgcactagccttttacctgggaggtgatatgtctttggcagtggatatcggaaaatcaatcaaccgacaacatgatactggctttcgggagctcttagaacccaaagtctggactgataagcatttggcaggtgaagtacaaagctttgctgcattgatgaagcagacattaactgaaatgactgatgagtatcatgtcgcaaatgctatggcaaaaatccctcaagcaccttcctcagatcttgtatttataccactacaagcctacctgaaggttctcaaatttatcgagtgtgttcaatatggcaaaaaggagcgtggccatgaaccaaaacgcgatgggatgatcaattaccataacctgtctaatggtacacatgcagaaataagaaacctctttacactggtggtttttgacacactgtaccctacagacacggaggatgaaaatgactgcagttcttag

SEQ ID NO: 578 - protein, 471 aa, Zea mays
MEGLEWKKISAKRFGIKESMIPPEAWNVLHRLRSRGYDVYLVGGCVRDLIMKKTPKDFDIITTADLRQVKDTFLGSAVIVGRRFPICHVHENNSIVEVSSFNTCARGSSGSQIYNSKSQNCSKNDFVRWKNCQRRDFTINGLMFNPYSEKIYDYLGGIEDIKKAKVRTVIPAGTSFQEDCARILRAIRIAARLGFSFPKETAYYVRTLACSVARLDKARILMEMNYMLAYGSAEASLRLLWRFGLLEHLLPFQAAYFSSTRFKRKDKGTNMLLVLFSKLDNFLAPNRPCHNSLWISLLAFHEALARKPCDPLIVATFALAFYLGGDMSLAVDIGKSINRQHDTGFRELLEPKVWTDKHLAGEVQSFAALMKQTLTEMTDEYHVANAMAKIPQAPSSDLVFIPLQAYLKVLKFIECVQYGKKERGHEPKRDGMINYHNLSNGTHAEIRNLFTLVVFDTLYPTDTEDENDCSS

SEQ ID NO: 579 - DNA, 2613 bp, Arabidopsis thaliana
atggcaatggaggttacgcagttgctcattaatgctcagtcgattgatggaactgtacgtaagcacgcggaagaaagtcttaagcagtttcaggagcaaaaccttgcgggtttcttgttgtcgcttgctggagagcttgcgaatgatgagaagccagtagatagcaggaaattagctggtttagtccttaaaaatgctcttgatgctaaggaacaacacaggaagtatgagcttgttcagagatggttggctctagacatgtcaacaaagtcgcagatcagagctttcttgttgaagacactgtcggcacctgtgcctgatgttcgttcgactgcatctcaggtcattgctaaggttgcaggtattgagttaccacagaagcagtggcctgagctcatagtgtctcttctctcaaatattcaccagttacctgctcatgtcaagcaagccactttggagactcttggatacctatgtgaagaagtgtcacctgatgttgttgaacaggagcatgtaaataagatactcacagctgttgttcagggtatgaatgctgctgaaggtaatactgatgttagacttgctgcaacccgtgctttatacatggctctcggattcgcccaagcaaatttcaacaacgacatggagcgtgattatatcatgagagttgtgtgtgaagcaaccctgtcccctgaggtgaaaattaggcaggcagcttttgagtgtttggtatctatcgcttccacatactatgagaagttggcgcattacatgcaagatatattcaacatcacagctaaggctgtaagagaagatgacgagtctgttgctctacaggcaattgagttctggagttctatttgtgacgaagagattgacatcttagaagaatatggtggtgagttcgctggggattctgatgttccatgcttttattttactaagcaggctctccctggtcttgtgcctctactgctggagactcttctgaagcaagaagaagatcaagatttggatgaaggggcttggaatattgcaatggcaggtgggacatgcctcggtttggttgctagggcagttggagatgacattgttccacatgtcatgccgtttattgaagagaaaatatcaaagcctgattggagagagcgagaagctgcaacttatgcttttggttccattttggaaggcccttctgccgataagttgatggcaattgttaacgcagcgttaacatttatgctcaatgctctaacaaatgacccaagcaaccatgtgaaagacacaaccgcatggacccttggtcggatatttgagttccttcatggttcaacaatcgagacacctattattaatcaggcaaactgccagcagataatcacagtactcatccagagcatgaatgatgcgcctaatgttgccgagaaggcttgtggggctctgtacttccttgctcaaggctatgaggatatcggtcccagttctccgttaacacccttcttccaggaaattattaagtcacttttagctgttgcacacagagaggatgcaactgaatcacgcttgcggactgcagcatatgaggcattgaatgaagttgtcaggtgttcaactgatgaaacgtctaccatggttctgcaattagtaccagtgataatgatggagcttcacaatactttggaaggggaaaagctttcattggatgagagggagaaacaaaacgagttgcagggacttctatgtggatgcttgcaggtcatcatacagaaattaggatctgaaccaaccaagtctaagttcatggagtatgcagaccaaatgatgggacttttcctgagggtgtttggttgtagaagtgcaactgcacatgaggaagccatgcttgccattggtgctcttgcttatgcagcaggtcccaattttgccaaatacatgcctgagttttataagtacttggagatgggtcttcaaaactttgaagaataccaagtgtgtgctgttactgttggtgttgttggggatgtctgcagagcattggaggacaagattttaccttattgcgatgggattatgacacagcttctgaaagatttgtcgagcaaccaattgcaccgatcagtgaagccaccgatattctcctgttttggtgacatagcacttgctatcggtgaggattttgataagtactggaggtattcaatgccgatgcttcagagtgccgcagagttatctgctcactcggctggagctgatgatgaaatgacggagtacacaaactcattgagaaacggaatccttgaggcttattcaggcatatttcaaggtttcaagaactccgccaaaacccagctcctgattcctttcgcaccccatatcctccagtttttggacagtatatacatggagaaagacatggacgaggtggtgatgaagacagcgattggggtcttaggagatttagcagatacactagggagtcatgtgggtggtttgatacaacagtcagtgtcaagtaaagagttcttaaacgaatgtttgtcttctgaagaccacacaattaaagaagcagccgaatgggcgaagcatgccataacccgtgccatatctgtttga

SEQ ID NO: 580 - protein, 870 aa, Arabidopsis thaliana; identical to SEQ ID NO: 50

SEQ ID NO: 581 - DNA, 2616 bp, Arabidopsis thaliana
atggctatggagatcacacagttccttctggctgcccagtcagccgatgcaagagtccgtactgaagcagaggctagtctcagacagttccaagaacaaaacttgccgctgttcttgttatccttgtcttttgagcttgaaaacaatgataaacctgctgaatcccgtcgactagccggtattctgctaaagaattctctggacgccaaagattctgccacaaaagatcatctggtgaaacaatggtttgcaattgatgttgctcttaaatcccagatcaaggatcgcttactaagaactcttggttcatctgccctagaggcaaggcatacttcagctcaggttattgctaaggtagcctccattgaaattcctcagaagcagtggcctgaacttgttggatcgctgcttaacaatatgactcagcaaggcagtcccgcacacttgaagcaatcaaccttggaaactctaggctatgtctgtgaagagatatcacaccatgatcttgtgcaagatgaagtgaattctgtcctcacagcagttgtgcagggcatgaaccagtctgaaaatactgctgaagttcgtctcgcagcaacaaaggcactgttaaatgccttggatttctctcagacaaattttgagaatgaaatggagaggaattacatcatgaagatggtatgcgagacagcatgttccaaggaggcagagatcaggcaagctgctttcgagtgccttgtgtccattgcatccacatactatgaggtgctggagcactacatacaaacactctttgagctcacatcgaatgctgtaaagggagatgaagagagcgttgccctccaagcaattgagttctggagttccatctgtgatgaagagatcgaccgtcaagagtatgacagtcctgatagtggtgactcatcccctccccactcctgtttcatagagaaggctcttccccatttagttcaaatgttgctagaaactctgctgaagcaggaagaggatcaggaccatgacgacgatgtctggaacatatctatggctggcgggacatgccttggcctggttgctagaacggttggagatggtgtagtccctcttgtgatgccttttgttgaaaaaaacataagttcgccagattggcgaagccgggaggcagccacttatgcttttggatcaattttggagggcccaacaattgataagcttgccccgatggtagctgctggcttggaatttctccttaatgcaaccaaggatcagaataaccatgtcagggatacaactgcttggactctgagccgtatctttgaatttttgccatccccagacagtggcttctctgttatatcacccgaaaacctccctagaattgtgagtgtattactggaatcaattaaagatgtgccaaatgttgcagagaaggtctgtggagcaatatacaatcttgcacagggatatgaagactctggagcaagttcctctcttctctctccttatcttacagagatcatcacacatctccttgcagctgctgagcgtacagatggggcagagtctaagctaagaggtgctgcgtatgaaaccttgaacgaggttgtccggtgttcaaacctttcagaggcctcaagcatcatagcgcatctcctccctgccatcatgaaaaaattagctgagacaatggacctccctataatatcaactgatgaccgtgagaagcaagcggaactccaggcgtctctgtgcggtgttctccaagtcataatccagaagctgagcagcagggacgatatgaaacctatcatagtgcaaaacgcagatgacatcatgaggttattcctaagagtgtttggttgccatagttcaagtgtccacgaagaagccatgcttgcaatcggtgctcttgcctatgcgactggaactgagtttgtgaaatacatgcccgagctttttaaatatctccagatggggctgcagaatttcgaagaataccaagtctgctcaatcaccgtaggagtgattggtgacatatgccgtgcgctggatgaaaaaatcctacccttttgcgatcagataatgggtctccttatccaaaaccttcaaagtggtgcactccacagatcggtgaagcctccaatcttctcatgctttggagacattgctctggcgattggtgctcattttgaaaggtatgtagctccagctgttcagataatgcaaggtgctgctcaggtgtgtgcgcagatggacacccttgacgaggagcttatggattatgcaaaccaactccggagaagcatctttgaagcatactccgggatactgcaagggttcaaggatgcaaaggctgagctcatgatgccctatgctcaacatctgttgcagtttgttgaactagtatccaaagattccctgagggatgagagcgtgacaaaagccgcggttgcagcaatgggtgatcttgcggatgttgtaggggagaacacgaagcagttgttccaaaacttcaccttctgtgatgagttcctcaatgagtgtctcgaatcagaggatgaagatctcaaggtcactgcacgctggactcaaggaatgatcgcaagactcgtgctctaa

SEQ ID NO: 582 - protein, 871 aa, Arabidopsis thaliana
MAMEITQFLLAAQSADARVRTEAEASLRQFQEQNLPLFLLSLSFELENNDKPAESRRLAGILLKNSLDAKDSATKDHLVKQWFAIDVALKSQIKDRLLRTLGSSALEARHTSAQVIAKVASIEIPQKQWPELVGSLLNNMTQQGSPAHLKQSTLETLGYVCEEISHHDLVQDEVNSVLTAVVQGMNQSENTAEVRLAATKALLNALDFSQTNFENEMERNYIMKMVCETACSKEAEIRQAAFECLVSIASTYYEVLEHYIQTLFELTSNAVKGDEESVALQAIEFWSSICDEEIDRQEYDSPDSGDSSPPHSCFIEKALPHLVQMLLETLLKQEEDQDHDDDVWNISMAGGTCLGLVARTVGDGVVPLVMPFVEKNISSPDWRSREAATYAFGSILEGPTIDKLAPMVAAGLEFLLNATKDQNNHVRDTTAWTLSRIFEFLPSPDSGFSVISPENLPRIVSVLLESIKDVPNVAEKVCGAIYNLAQGYEDSGASSSLLSPYLTEIITHLLAAAERTDGAESKLRGAAYETLNEVVRCSNLSEASSIIAHLLPAIMKKLAETMDLPIISTDDREKQAELQASLCGVLQVIIQKLSSRDDMKPIIVQNADDIMRLFLRVFGCHSSSVHEEAMLAIGALAYATGTEFVKYMPELFKYLQMGLQNFEEYQVCSITVGVIGDICRALDEKILPFCDQIMGLLIQNLQSGALHRSVKPPIFSCFGDIALAIGAHFERYVAPAVQIMQGAAQVCAQMDTLDEELMDYANQLRRSIFEAYSGILQGFKDAKAELMMPYAQHLLQFVELVSKDSLRDESVTKAAVAAMGDLADVVGENTKQLFQNFTFCDEFLNECLESEDEDLKVTARWTQGMIARLVL

SEQ ID NO: 583 - DNA, 2622 bp, Arabidopsis thaliana
atggcgatggagatcacacagtttctgttggctgcccagtcagccgatgcaagagtccggactgaagcagagggtaatctcaggcaattccaagaacagaacttgccgctgttcttagtatccttgtcttttgagcttgccaacaatgataaacctgctgaatcccgtcgactagccggtattctgctaaagaattctctggacgccaaagattctgccacaaaagatcatctggtgaaacaatggtttgcaattgatgttgctcttaaatcccagatcaaggatcgcttactaagaactcttggttcatctgccctagaggcaaggcatacttcagctcaggttattgctaaggtagcctccattgaaattcctcagaagcagtggcctgaacttgttggatcgctgcttaacaatatgactcagcaaggcagtcccgcacacttgaagcaatcaaccttggaaactctaggctatgtctgtgaagagatatcacaccatgatcttgtgcaagatgaagtgaattctgtcctcacagcagttgtgcagggcatgaaccagtctgaaaatactgctgaagttcgtctcgcagcaacaaaggcactgtgtaatgccttggatttctctcagacaaattttgagaatgaaatggagaggaattacatcatgaagatggtatgcgagacagcatgttccaaggaggcagagatcaggcaagctgctttcgagtgccttgtgtccattgcatccacatactatgaggtgctggagcactacatacaaacactctttgagctcacatcgaatgctgtaaagggagatgaagagagcgtttccctccaagcaattgagttctggagttccatctgtgatgaagagatcgaccgtcaagagtatgacagtcctgctagtggtgactcatctcctccccactcctctttcatagagaaggctcttccccatttagttcaaatgttgctagaaactctgctgaagcaggaagaggatcaggaccatgatgacgacgtctggaacatatctatggctggcgggacatgccttggcctggttgccagaacagttggagatcatgtagtccctcttgtgatgccttttgttgaaaaaaacataagttcgccagattggcgctgccgggaggcagccacttatgcttttggatcaattttggagggcccaacaattgataagcttgccccgatggttgctgctggcttggaatttctccttaatgcaaccaaggatcagaataaccatgtcagggatacaactgcttggactctgagccgtatctttgaatttttgcactccccagacagtggtttctctgttatatcacccgaaaacctccctagaattgtgagtgtattactggaatcaattaaagatgtgccaaatgttgcagagaaggtctgtggagcaatatacaatcttgcacagggatatgaagactctggagcaagttcatctcttctctctccttatcttacagagatcatcacacatctgcttgcagctgctgagcgtacagatggggcagagtctaagctaagaggtgctgcgtatgaaaccttgaacgaggttgtccggtgttcaaacctttcagaggcctcaagcatcatagcgcatctcctccctgccatcatgaaaaaattagctgagacaatggacctccctataatatcaactgatgaccgtgagaagcaagcggaagtccaggcttctctgtgtggtgttctccaagttataatccagaagctgagcggcagggaggatacgaaacccatcataatgcagagcgcagatgacattatgaggctgttcctaagagtgtttggatgccatagttcaagtgtccacgaagaagccatgcttgcaatcggtgctcttgcatatgctactggagctgagtttgtgaaatacatgcccgagcttttcaaatatctccagatggggctgcagaatttcgaagaataccaagtctgctcaatcacagtaggagtgcttggtgacatttgccgtgccctggatgaaaaaatcctacctttttgcgatcagataatgggtctccttatccaaaaccttcaaagtggggcactccacagatcagtgaagcctccaatattctcatgctttggagacattgctctggcaattggtgctcattttgaaaggtatgtagcaccagccgttcagatcatgcaaggggctgctcaggtgtgtgctcagatggatacccttgacgaggagcttatggattatgcaaaccaactgcggagaagcatctttgaggcatactccgggatactacaagggttcaaggacacaaaagccgagctcatgatgccctacgctcaacatctcctgcagtttgttgaactagtatccaaagatcccctgagggatgagagcgtgacaaaagccgcggttgcagcgatgggtgatcttgcggatgttgtaggagagaacacaaagcagttgttccaaaacttcaccttcttcggtgagttccttaatgagtgtctcgaatcagaggatgaagatctcaaggtcactgcacgctggactcaaggaatgattgcaaggctcatgcacccatcataa

SEQ ID NO: 584 - protein, 873 aa, Arabidopsis thaliana
MAMEITQFLLAAQSADARVRTEAEGNLRQFQEQNLPLFLVSLSFELANNDKPAESRRLAGILLKNSLDAKDSATKDHLVKQWFAIDVALKSQIKDRLLRTLGSSALEARHTSAQVIAKVASIEIPQKQWPELVGSLLNNMTQQGSPAHLKQSTLETLGYVCEEISHHDLVQDEVNSVLTAVVQGMNQSENTAEVRLAATKALCNALDFSQTNFENEMERNYIMKMVCETACSKEAEIRQAAFECLVSIASTYYEVLEHYIQTLFELTSNAVKGDEESVSLQAIEFWSSICDEEIDRQEYDSPASGDSSPPHSSFIEKALPHLVQMLLETLLKQEEDQDHDDDVWNISMAGGTCLGLVARTVGDHVVPLVMPFVEKNISSPDWRCREAATYAFGSILEGPTIDKLAPMVAAGLEFLLNATKDQNNHVRDTTAWTLSRIFEFLHSPDSGFSVISPENLPRIVSVLLESIKDVPNVAEKVCGAIYNLAQGYEDSGASSSLLSPYLTEIITHLLAAAERTDGAESKLRGAAYETLNEVVRCSNLSEASSIIAHLLPAIMKKLAETMDLPIISTDDREKQAEVQASLCGVLQVIIQKLSGREDTKPIIMQSADDIMRLFLRVFGCHSSSVHEEAMLAIGALAYATGAEFVKYMPELFKYLQMGLQNFEEYQVCSITVGVLGDICRALDEKILPFCDQIMGLLIQNLQSGALHRSVKPPIFSCFGDIALAIGAHFERYVAPAVQIMQGAAQVCAQMDTLDEELMDYANQLRRSIFEAYSGILQGFKDTKAELMMPYAQHLLQFVELVSKDPLRDESVTKAAVAAMGDLADVVGENTKQLFQNFTFFGEFLNECLESEDEDLKVTARWTQGMIARLMHPS

SEQ ID NO: 585 - DNA, 2289 bp, Glycine max
atggcaatggaagttacccaggtgcttttgagtgctcaatcaattgacgggaatgtacggaagcatgctgaggacagtctccgacaatttcaggagcaaaaccttcctggattcttggtctctctctctggagagttagcaagtgaagataaaccggttgatagccgaaagttggcgggtttgatactgaaaaatgctttggatgccaaggatgaaaacagaaagcaggaattggtccaaagatggttgtcgctggaccctgtggcaaagactcaagttaagtcatgcttgctgcaaacactctcttctcttgtacctgatgctcggtctacagcaactcaagttattgctaaagttgctggaattgagcttcctcagaaacagtggcctgagctgataggatcacttttatcaaatattcatcaagttcctactcatgtcaagcaagcgactttggagaccctggggtatttgtgtgaggaggtatctcctcaggttgttgatcaagaccaagtaaataaaatacttactgccgtagttcaaggtatgaatgcgtctgaagggaacaatgatgttaggcttgctgctacaagggcattatataacgctcttgggtttgctcaagctaattttagcaatgatatggagcgtgattatatcatgagagttgtttgtgagacaactgtgtgccctgaactgaaaatacgtcaagcagcctttgaatgtttggtctcaattgcagccatgtattatgagaaattggctccttacatccaggatatatataacatcacagcaaaggctgttagggttgatgaggaacctgttgctcttcaagccattgaattttggagtacaatttgtgatgaggagactgatatcttagaagaatatatgggtgattccaatggagactccgatataccttgtttttatttcatcaagcaagctcttcctgcacttatccctctgctgttggaaacattactcaaacaagaagaggatcaggatctggacgaaggtgcatggaatattgcaatggcaggtggtacatgccttggtttagttgcccgtactgttggagatgatattgtgccgctggtaatgcccttcattgaggagaatatcacaaaaccagattggaggcaaagggaggcagcctcttatgcttttggatctatcttggaggggccttcacctgacaaattagctcctcttgttaaccatgccttaccatttatgcttagtgctttagtgaaggacccaaacaaccatgtgaaagacaccactgcttggactttgggacgaatgttcgaatttcttcacagttcaattgttggtacaccaatcattaatgagggaaattgccaacagattattacagttctccttcaaagcatgaaggatgttcccaatgttgctgagaaggcctgtggtgctctgtattttcttgcccagggttatgaggatgttggaccaacatctccgctaactcccttgtttcaggaaattgttcaatcccttctaactgttacccacagagaggatgctacagaatctcgattgagaactgcggcatatgaaacattgaatgaagtagtaaggtgttcaacagatgaaacagctactttggtggtacaactagtttctgtcatcatgatggagctgcacaaatgtcttgaagcacaaaatctttcatcggatgagagagaaaagcggagtgaattgataggccttctttgtgggtgcatgcaagtaattattcagaaactagggtctttggattctaccaaatatgtgttggtgcagtattctgatcagataatgagactattcttcagggtctttgcttgtagaaatgccactgcacacgaggaggcaatgctagccattggagcccttgcctactcaataggccaggagttttccaattacatgccagaattttacaagtttctcgagatggaccttcagaactttgaggagtaccaagtttgtgctgtcactgttggtgtcataggggacatatgcagggcattggagttaaaaatactgccttattgtgatgggattatgacacaactcctcaagaatttgtcaagtgataatttgcaccgttctgtgaagccccctttattctcatgcattggtgatattgcacttgcaataggagataacttcaataaatacttaatgtatgcaatgaacacactacaacttgctgcagagatgtatgcccacacgtcaggttttgatgatgaaatgacaggagtatatcaaattctttga

SEQ ID NO: 586 - protein, 762 aa, Glycine max
MAMEVTQVLLSAQSIDGNVRKHAEDSLRQFQEQNLPGFLVSLSGELASEDKPVDSRKLAGLILKNALDAKDENRKQELVQRWLSLDPVAKTQVKSCLLQTLSSLVPDARSTATQVIAKVAGIELPQKQWPELIGSLLSNIHQVPTHVKQATLETLGYLCEEVSPQVVDQDQVNKILTAVVQGMNASEGNNDVRLAATRALYNALGFAQANFSNDMERDYIMRVVCETTVCPELKIRQAAFECLVSIAAMYYEKLAPYIQDIYNITAKAVRVDEEPVALQAIEFWSTICDEETDILEEYMGDSNGDSDIPCFYFIKQALPALIPLLLETLLKQEEDQDLDEGAWNIAMAGGTCLGLVARTVGDDIVPLVMPFIEENITKPDWRQREAASYAFGSILEGPSPDKLAPLVNHALPFMLSALVKDPNNHVKDTTAWTLGRMFEFLHSSIVGTPIINEGNCQQIITVLLQSMKDVPNVAEKACGALYFLAQGYEDVGPTSPLTPLFQEIVQSLLTVTHREDATESRLRTAAYETLNEVVRCSTDETATLVVQLVSVIMMELHKCLEAQNLSSDEREKRSELIGLLCGCMQVIIQKLGSLDSTKYVLVQYSDQIMRLFFRVFACRNATAHEEAMLAIGALAYSIGQEFSNYMPEFYKFLEMDLQNFEEYQVCAVTVGVIGDICRALELKILPYCDGIMTQLLKNLSSDNLHRSVKPPLFSCIGDIALAIGDNFNKYLMYAMNTLQLAAEMYAHTSGFDDEMTGVYQIL

SEQ ID NO: 587 - DNA, 2613 bp, Glycine max
atggccatggaggttactcaaatccttttaaacgcgcaagcagtcgatggcacattaaggaaacaagccgaggaaagcttgaaacaatttcaggaacagaatcttccaagtttcttgttttctcttgctggggaactggcaaatgacgacaagcctgcagagagtcgcaagctagcaggtttaattctgaagaatgctctggatgctaaagagcagcacagaaaaatagaatttgttcaaagatggttgtcattggacccaactttgaaatcccagattaaggcattcttgttaaggacactttcttctccttctcttgatgcccggtcaactgcatcacaggttattgctaaagttgctggcattgagttgcctcataaacagtggcctgaattgataggatccctcttgtctaatgctcatcagcttcctgcccctacaagacaggcaacacttgagacccttggttacatctgtgaagaagtttcccctgatgtagtagaccaggatcatgtaaataagatactcactgctgttgttcaagggatgaattcaacagaagaaaacaatgatgtcaggcttgctgccataaaagcattgtacaatgcattgggttttgctcaggcgaatttttctaatgacatggagcgggattatatcatgagaattgtgtgtgagacaacacaatctcctgaattgaagattcgacgagcagcttttgagtgcttggtagctatttcttcgacatactatgaaaagttagctccttatatccaagatatcttcaacatcactgccaaggctgtgagggaagatgaggagccggttgcacttcaggcaattgagttttggagttcaatatgtgacgaagaaattgatatactagaagaatatggtggtgattttagtggggattcagaggttccctgcttttattttattaaacaggcactttcatttcttgtccccatgttattggagacactgctgaagcaagaagaagatcaagaccaggatgaaggagcatggaacattgctatggctggaggtacctgcttgggattagttgcacggacagttggtgatgacattgtacctttggttatgccgtttattgaagagaatataaccaaaccagattggaggcaaagggaagctgcaacttatgcctttggctctattttagaaggtccctcccctgataaacttgtgccactggtgaatatggctttgaatttcatgctcactgcattgatgaaagatccaaataatcacgtgaaggacacaactgcatggactctagggcgaatgttcgaatttttgcatggatcagctctggatactccgattattactccagcaaactgccaacagattattactgtgctgcttcagagcatgaaggatgttccaaatgttgctgagaaggcttgtggtgctctttattttcttgcccaaggctatgaggatgctgcatctgcgtcctctccattgacccccttctttcaagatattgttcatgctcttctcactgtaactcacagagaggatgctggagaatcccgccttagaacagcagcctatgaagccttaaatgaagtagtgaggtgttctaatgatgaaacagctcctatggtggtacaacttgttcctctcatcatgatggagctccatcagactcttgagaatcagaaggtttcatctgacgagaggcagaatgagttacaaggccttctatgtggttgcttgcaggttatcatacagaagttaggatcatctgaaccaacaaagtatcatttcatgcagtatgctgaccaaataatgggtttatttttgagagtgtttgcttctcgaagtgcaacagctcatgaggaggctatgcttgccattggagctttggcctatgcaactggtgctgattttgcgaaatacatgacagaattttacaagtacttggagatgggtctccaaaattttgaggactaccaggtatgtgctatcacagtgggtgtggttggtgatgtatgcagagccttggaggagaaagtactgccttattgtgatgggataatgacccaacttcttaaggatttgtccagcaatcagctgcataggtctgttaagcctcctattttttcatgttttggagacatagccttggcaattggagaaaactttgagaagtacttgttatatgcaatgcctatgcttcagagtgctgcagaactctctgctcatacatctggtgctgatgatgatatgacagaatacacaaattctttgagaaatggaattctagaggcatactcagggatcttccaaggatttaaaggttccccaaagacccagcttctgatgtcttatgctcctcatgtgctgcaattcttggatagtttgtatatggagaaggacatggatgatgttgtgactaagacagcaattggcgtgcttggagatttagctgatactttgggcagtagtgctggccccttgattcagcaatctgtgtctagcaaagacttcctcaaagagtgtttatcatctgatgaccatttgattaaggaatctgccgaatgggccaagttggcaatcagtcgagcaatttcattttga

SEQ ID NO: 588 - protein, 870 aa, Glycine max
MAMEVTQILLNAQAVDGTLRKQAEESLKQFQEQNLPSFLFSLAGELANDDKPAESRKLAGLILKNALDAKEQHRKIEFVQRWLSLDPTLKSQIKAFLLRTLSSPSLDARSTASQVIAKVAGIELPHKQWPELIGSLLSNAHQLPAPTRQATLETLGYICEEVSPDVVDQDHVNKILTAVVQGMNSTEENNDVRLAAIKALYNALGFAQANFSNDMERDYIMRIVCETTQSPELKIRRAAFECLVAISSTYYEKLAPYIQDIFNITAKAVREDEEPVALQAIEFWSSICDEEIDILEEYGGDFSGDSEVPCFYFIKQALSFLVPMLLETLLKQEEDQDQDEGAWNIAMAGGTCLGLVARTVGDDIVPLVMPFIEENITKPDWRQREAATYAFGSILEGPSPDKLVPLVNMALNFMLTALMKDPNNHVKDTTAWTLGRMFEFLHGSALDTPIITPANCQQIITVLLQSMKDVPNVAEKACGALYFLAQGYEDAASASSPLTPFFQDIVHALLTVTHREDAGESRLRTAAYEALNEVVRCSNDETAPMVVQLVPLIMMELHQTLENQKVSSDERQNELQGLLCGCLQVIIQKLGSSEPTKYHFMQYADQIMGLFLRVFASRSATAHEEAMLAIGALAYATGADFAKYMTEFYKYLEMGLQNFEDYQVCAITVGVVGDVCRALEEKVLPYCDGIMTQLLKDLSSNQLHRSVKPPIFSCFGDIALAIGENFEKYLLYAMPMLQSAAELSAHTSGADDDMTEYTNSLRNGILEAYSGIFQGFKGSPKTQLLMSYAPHVLQFLDSLYMEKDMDDVVTKTAIGVLGDLADTLGSSAGPLIQQSVSSKDFLKECLSSDDHLIKESAEWAKLAISRAISF

SEQ ID NO: 589 - DNA, 2616 bp, Glycine max
atggcaatggaagttacccaggtgcttttgagtgctcaatcaattgacggaaatgtacggaagcatgctgaggacagtctacgacaatttcaggagcaaaaccttcctggattcttggtctctctatctggagagttagcaagtgaagataaaccggttgatagccgaaagttggcgggtttgatactgaaaaatgctttggatgccaaggatgaaagcagaaagcaggaattggtccaaagatggttgtcgctggaccctgtggcaaagacccaagttaagtcatgcttgctacaaacactctcttctcttgtacctgatgctcggtctacagcaacccaagttattgctaaagtcgctggaattgagcttcctcagaaacagtggcctgagctgataggatcacttttatcaaatattcatcaagtaccttctcatgtcaaacaagcgactttggagaccctggggtatttgtgtgaggaggtatctcctcaggttgttgatcaggaccaagtaaataaaatacttactgccgttgttcaaggtatgaacgcgtctgaagggaacaatgatgttaggcttgctgctacaagggcattatataacgctcttgggtttgctcaggctaattttggcaatgatatggagcgtgattatatcatgagagttgtttgtgagacaactgtgtgccctgaagtgaaaatacgtcaagcagcctttgaatgtttggtctcaattgcagccatgtattatgaaaaattggctccttacatccaggatatatataacatcacagaaaaggctgttaggggtgatgaggagcctgttgctcttcaagccattgaattttggagtacaatttgtgatgaggagactgatatcttggaagaatatatgggtgattccaatggagactccgatataccttgtttttattttattaagcaagctcttcctgcacttatccctctgctgttggaaacattactcaaacaagaagaggatcaggatctggacgaaggtgcatggaatattgcaatggcaggtggtacatgccttggtttagttgctcgtactgttggagatgatattgtgccactggtaatgcccttcattgaggagaatattacaaaaccagattggaggcaaagggaggcagcctcatatgcttttggatctatcttggaggggccttcacctgacaaattagctcctcttgttaaccatgccttaccatttatgcttagtgccttagtgaaggacccaaacaaccatgtgaaagacaccactgcttggactttgggacgaatgttcgaatttcttcacagttcagttgttggtacatcaattattaatgagggaaattgccaacagattattactgttctccttcaaagcatgaaggatgttcccaatgttgctgagaaggcctgtggtgctctgtattttcttgcccagggttatgaggatgttggaccaacatctcctctaactcccttttttcaggaaattgttcaatcccttctaactgttacccacagagaggatgctacagaatcacgattgagaactgcagcatatgaaacattgaatgaagtagtaaggtgttcaacagatgaaacagcttctttggtggtacaactagtttctgtcatcatgatggagctgcacaaatgtcttgaagtacaaaatctttcatctgatgagagagaaaagcagagtgaattgataggccttctttgtggatgcatgcaagtaattattcagaagctagggtctttagattctaccaaatatctgttgttgcagtattctgatcagataatgggacaattcttcagggtctttgcttgtagaaatgccactgcacatgaagaggcgatgctagccatcggagcccttgcctactcgattggccatgagtttgccaagtacatgccagaattttacaagtttctcgagatggaccttcagaactttgaggagtaccaagtttgtgctgtcactgttggtgtggtaggggacatatgcagggcattggaggaaaaaatactgccttattgtgatgggattatgacacaacttctcaagaatttgtcaagtgataatttgcaccgttctgtgaagcccccattattctcatgcattggtgatatagcacttgcaataggagataactttaataaatacttaatgtatgcaatgaacacactacaacttgctgcagagatgtatgcccacacatcaggttttgatgatgaaatgacagagtacattaattccttgagaaatgggatattagaggcatattctgcgatttttcaagggtttaagaattcatcaaagacccagctcttgattccttatgcacctcatatcctccagtttttggatagcatatacgtggaaaaagacatggacgaggtagttatgaaaacagcaattggagtccttggagatctagctgatacacttggaagcaatgctggttctttaatacagcagtctttgtcaagcagagactttttgaatgaatgtttgacctctgaagatcatttgattaaggaatctgctgagtgggccaggttggctatcaatcgtgctatatctgtttga

SEQ ID NO: 590 - protein, 871 aa, Glycine max
MAMEVTQVLLSAQSIDGNVRKHAEDSLRQFQEQNLPGFLVSLSGELASEDKPVDSRKLAGLILKNALDAKDESRKQELVQRWLSLDPVAKTQVKSCLLQTLSSLVPDARSTATQVIAKVAGIELPQKQWPELIGSLLSNIHQVPSHVKQATLETLGYLCEEVSPQVVDQDQVNKILTAVVQGMNASEGNNDVRLAATRALYNALGFAQANFGNDMERDYIMRVVCETTVCPEVKIRQAAFECLVSIAAMYYEKLAPYIQDIYNITEKAVRGDEEPVALQAIEFWSTICDEETDILEEYMGDSNGDSDIPCFYFIKQALPALIPLLLETLLKQEEDQDLDEGAWNIAMAGGTCLGLVARTVGDDIVPLVMPFIEENITKPDWRQREAASYAFGSILEGPSPDKLAPLVNHALPFMLSALVKDPNNHVKDTTAWTLGRMFEFLHSSVVGTSIINEGNCQQIITVLLQSMKDVPNVAEKACGALYFLAQGYEDVGPTSPLTPFFQEIVQSLLTVTHREDATESRLRTAAYETLNEVVRCSTDETASLVVQLVSVIMMELHKCLEVQNLSSDEREKQSELIGLLCGCMQVIIQKLGSLDSTKYLLLQYSDQIMGQFFRVFACRNATAHEEAMLAIGALAYSIGHEFAKYMPEFYKFLEMDLQNFEEYQVCAVTVGVVGDICRALEEKILPYCDGIMTQLLKNLSSDNLHRSVKPPLFSCIGDIALAIGDNFNKYLMYAMNTLQLAAEMYAHTSGFDDEMTEYINSLRNGILEAYSAIFQGFKNSSKTQLLIPYAPHILQFLDSIYVEKDMDEVVMKTAIGVLGDLADTLGSNAGSLIQQSLSSRDFLNECLTSEDHLIKESAEWARLAINRAISV

SEQ ID NO: 591 - DNA, 2613 bp, Glycine max
atggccatggaggttactcaaatccttttaaatgcccaagcagtggatggaacattaaggaaacaagccgaggaaagcctgaaacaatttcaggaacagaatcttccaagtttcttattttctcttgctggggaactggcaaatgacgagaagcctgcagagagtcggaagctagcaggtttaattctcaagaatgctctggatgctaaagagcagcacagaaaaatagaatttgtccaaagatggctgtcattggacccaaccttgaaagctcagattaaggcattcttgttgaggacactttcttccccttctcttgatgcccgatcaactgcatcacaggttattgctaaagttgctggcattgagttgcctcataaacagtggcctgaattgataggatccctgttgtctaatgctcatcagcttcctgcccctacaagacaggcaacacttgagacccttggatacatctgcgaagaagtttccccagatgtagtagaccaggatcatgtaaataagatactcactgctgttgttcaagggatgaattcaacagaagaaaacaacgatgtcaggcttgctgccataaaagcattgtacaatgcattgggttttgcccaggcaaatttttcgaatgacatggagcgggattatatcatgagaattgtgtgtgagacaacacaatctcctgaactgaagattcgacgagcagcatttgagtgcttggtagctatttcttcgacatactatgaaaagttagctccttatatccaagatatcttcaacatcactgccaaggctgtgagggaagatgaggagccagttgcacttcaggcaattgagttttggagttcaatatgtgacgaagaaattgatatactagaagaatatggaggtgatttcagtggggattcagaggttccctgcttttattttattaaacaggcactttcatttcttgtccccatgttattggagacactgctgaagcaagaagaagatcaagaccaggatgaaggagcatggaacattgctatggctggaggtacctgcttgggattagttgcacggacagttggtgatgacattgtacctttggttatgccgtttattgaagagaatataaccaaaccagattggaggcaaagggaagctgcaacttatgcctttggctctattttagaaggtccatctcctgataaacttgtgccattggtgaatatggctttgaatttcatgctcactgcattgatgaaagatccgaataatcatgtgaaggacacaactgcatggactcttgggcgaatgttcgaatttttgcatggatcagctctggatactcccattatcactccagcaaactgccaacagattattactgtgctgcttcagagcatgaaagatgttccaaatgttgctgagaaggcttgtggtgctctttattttcttgcccaaggctatgaggatgctggatctgcatcctctccgttgacccccttcttccaagaaattgttcatgctctcctcactgtaactcacagagaggatgctggagaatcccgccttagaacagcagcctatgaagcgttaaatgaagtagtgaggtgttctaatgatgaaacagctcctatggtggtacaacttgttcctctcatcatgatggaactccatcagactcttgagaatcagaaggtttcatccgacgagaggcagaatgagttacaaggccttctatgtggttgcttgcaggttatcatacagaagttaggatcatctgaaccaacaaaatatcatttcatgcagtatgctgaccaaattatgggtttgtttttgagagtgtttgcttctcgaagtgcaacagctcatgaggaggctatgcttgccattggggctttggcctatgcaaccggtgctgattttgcgaaatacatgacagaattttacaagtatttggagatgggtctccaaaatttcgaggactaccaggtttgtgctatcacagtgggtgtggttggtgatgtatgcagagccttggaggagaaaatactgccttattgtgatgggataatgacccaacttcttaaggatttgtctagcaatcagttgcataggtccgttaagcctcctattttttcatgttttggagacattgccttggcaattggagaaaactttgagaaatacctgttatatgcaatgcctatgcttcagagtgccgcagagctctctgctcatacatctggtgctgatgacgatatgacagaatacactaattctttgagaaatggaattctagaggcatactcagggatcttccaagggtttaaaggttccccaaagacccagcttctgatgccatatgctcctcatgtgctgcaattcttggatagtttgtataatgagaaggacatggatgatgttgtgactaagacagcaattggcgtgcttggagatttagctgatactttgggtagtaacgctggcccgttgattcagcaatctgtgtccagcaaagacttccttaaagagtgtttatcatctgatgatcatttgattaaggaatctgcggaatgggccaagttggcaatcagtcgagcaatttctttttga

SEQ ID NO: 592 - protein, 870 aa, Glycine max
MAMEVTQILLNAQAVDGTLRKQAEESLKQFQEQNLPSFLFSLAGELANDEKPAESRKLAGLILKNALDAKEQHRKIEFVQRWLSLDPTLKAQIKAFLLRTLSSPSLDARSTASQVIAKVAGIELPHKQWPELIGSLLSNAHQLPAPTRQATLETLGYICEEVSPDVVDQDHVNKILTAVVQGMNSTEENNDVRLAAIKALYNALGFAQANFSNDMERDYIMRIVCETTQSPELKIRRAAFECLVAISSTYYEKLAPYIQDIFNITAKAVREDEEPVALQAIEFWSSICDEEIDILEEYGGDFSGDSEVPCFYFIKQALSFLVPMLLETLLKQEEDQDQDEGAWNIAMAGGTCLGLVARTVGDDIVPLVMPFIEENITKPDWRQREAATYAFGSILEGPSPDKLVPLVNMALNFMLTALMKDPNNHVKDTTAWTLGRMFEFLHGSALDTPIITPANCQQIITVLLQSMKDVPNVAEKACGALYFLAQGYEDAGSASSPLTPFFQEIVHALLTVTHREDAGESRLRTAAYEALNEVVRCSNDETAPMVVQLVPLIMMELHQTLENQKVSSDERQNELQGLLCGCLQVIIQKLGSSEPTKYHFMQYADQIMGLFLRVFASRSATAHEEAMLAIGALAYATGADFAKYMTEFYKYLEMGLQNFEDYQVCAITVGVVGDVCRALEEKILPYCDGIMTQLLKDLSSNQLHRSVKPPIFSCFGDIALAIGENFEKYLLYAMPMLQSAAELSAHTSGADDDMTEYTNSLRNGILEAYSGIFQGFKGSPKTQLLMPYAPHVLQFLDSLYNEKDMDDVVTKTAIGVLGDLADTLGSNAGPLIQQSVSSKDFLKECLSSDDHLIKESAEWAKLAISRAISF

SEQ ID NO: 593 - DNA, 915 bp, Hordeum vulgare
atgagagggagaagcggaccgatctgcagggccttctcttgtggttgcctacaggtcattatccagaaagtgggagggatggagtcaacaaagtttgccttcttacagtatgcagatcagatgatggatctgtttttgagagtttttgcttgccgaaatgccacggtgcatgaggaggctatgcttgctatcggtgcactggcatatgcagccggttcgaactttgcgaagtacatggcacaattctatcagtatttggaaatgggacttcagaactttgaagagtatcaggtatgtgccattacggtgggtgttgtgggcgacttgtgcagggcactggaggacaaaattttgccctactgtgatggcatcatgacccagctcctgaaggatctatccagcaatcagttgcacagatctgtaaaaccacctatattctcatgcttcggtgatattgcactggcaattggagagaacttcgagaagtatttgatctatgccatgcccatgctacaaagtgcagcagatttgtcggcgcacacaactgcaactgatgatgaaatgcttgactacaccaatcaattaagaaatggcatcttggaggcctactctggtattcttcaaggattcaagagttcccctaagacacagttactcatgccgtatgctccacatattcttcagttccttgatgcccttcataatggaaaggatatggatgattctgtgatgaagactgcaataggtgtcttaggagatcttgcagacacattgggcgtcaatgctggtcctttgatcaatcaatccacatcaagcaagcaatttttggatgagtgcttatcatctgatgatcctttggtcaaagaatcagctgactgggcaaggattgcaatcagccgtgcagtttcaggttga

SEQ ID NO: 594 - protein, 304 aa, Hordeum vulgare
MRGRSGPICRAFSCGCLQVIIQKVGGMESTKFAFLQYADQMMDLFLRVFACRNATVHEEAMLAIGALAYAAGSNFAKYMAQFYQYLEMGLQNFEEYQVCAITVGVVGDLCRALEDKILPYCDGIMTQLLKDLSSNQLHRSVKPPIFSCFGDIALAIGENFEKYLIYAMPMLQSAADLSAHTTATDDEMLDYTNQLRNGILEAYSGILQGFKSSPKTQLLMPYAPHILQFLDALHNGKDMDDSVMKTAIGVLGDLADTLGVNAGPLINQSTSSKQFLDECLSSDDPLVKESADWARIAISRAVSG

SEQ ID NO: 595 - DNA, 2607 bp, Hordeum vulgare
atggatatcactcagattctgctagctgctcagtctccagatggtaaccttcgctcagcagcagaagccaacatcaagcagttccaggagcagaatcttcccaacttcctcctatccttgtcggtggagttatcgaatgatgaaaggccaccagagtctagaagacttgctggtattatccttaagaattcactggacgcaaaagattctgcaaggaaggagctgctgattcagcaatgggtcagcttggatcactcgatcaaatcgcagattaaggagtcattgctgataacactaggatcttcggtgggtgatgcccggcagacgtcatcacaagtcattgcaaagattgcatccattgagataccccgtcgggaatggcaagacctcattgccaaattgctgagcaacatgactcagcctggggcctctgcgccactaaagcaagcaactctagaagcattggggtatgtctgtgaggagattcctcctgagcacttggagcaggatcaagtgaatgctgttctgactgctgtggttcaggggatgaaccagacagagctaagctctgaagtccgtcttgcagcagtcaaagctctatataatgctcttgactttgctgagagcaactttgcaaatgagatggagaggacctttataatgaaggtaatttgtgatactgctgtatctaaagaagtggagatcagacaggcagcctttgaatgccttgtggcaattgcatccacatattatgtgcacttagatccttatatgcaaaccatattcaacctgacagctaatgctgtaaaaggagacgaggaaccagttgcactgcaagctgttgagttctggagtactatttgtgaggaggagattgaactccaagaggaatatgagggatctgatgatgctaactcgactgtaaattatcgcttcattgaaaaggccctcccttcacttgttccaatgctgctagaaaccctgttgaagcaagaggaagatcaagagcaagatgataatgcttggaacatttccatgagtggtggaacatgccttggactcattgctagaactgtcggtgatgcaattgtccctcttgtgatgccatttgttgaagctaacatcacaaagccggattggcgttgtcgtgaggcagcaacttttgcatttggttctatccttgatggcccatcccttgagaaacttgctcccttggtgcaggctggactagatttcttgctcaatacaatgaatgatccaaacagccaggtaaaagacaccactgcttggactcttggacgggtatttgagcttttgcattctccatgcagtactaatccaatcatatcaaatgcaaaccttcctcgtatcatggctgtgttgctagagagtagcaaagatgttccaaatgtggctgagaaagtctgtggagccatatattttcttgcccaaggttatgaagatgcagagccggtgtcatctttgcttacaccttatcttcctaatgttatcgctgcactccttactgctgcggatcgtagtgatatgacccatgtgaggcttcgtgcatctgcttatgaagcgctgaatgagattgtaagagtcagcaacatacctgaaacttcaagcatcataggccagttattgcaggagatcatgagaagattgaatctgacatttgaccaccaaatattttcatcaggcgacaaggagaagcaaagcgatctgcaggctttgttgtgtggtgtactgcaggtcattatccagaaactgaacagctcggatgcaaagtccataattgcacagactgctgaccagttgatgcttctgttcctccgtgtctttgcttgccacagtgctactgtacatgaagaagcaatgctggccattggtgctcttgcttatgccactggcccagattttgagaaatacatgcctgagtttttgaagtaccttgaggcaggattgcagaattatgaagaataccaagtatgctccatctctgtaggggtggtgggtgatatttgccgtgccttggaagataaaatcttgcccttctgtgatgggattatgactgtgcttctcaaggatctctcaaactcacagctcaacaggtctgtcaagcccccaattttctcatgctttggagacattgctcttgccattggtgaaaattttgagaaatacctgccgtatgctatgccgatgcttcaaggggcggctgagcttcttgttgttttggatcaaaatgacgaggatatggttgattatggtaaccagctcagacggggaatttttgaggcatactctggcatactacagggtctaaagggcgcaaaagctcagctgatgataccttatgcaggccatctattgcaattcactgaagctgtctacaaagatgggagcagggatgagagcgtgacaaaagccgccgttgctgtcctgggggatcttgcggacacacttgggccaatctctaaggatctgttcaagagccacctcttccatgttgagttcttgagggagtgcctcgatctggatgatgaagtgagggagacggcgtcatggacccaggggatgataaaccaagcgatagtttcttag

SEQ ID NO: 596 - protein, 868 aa, Hordeum vulgare
MDITQILLAAQSPDGNLRSAAEANIKQFQEQNLPNFLLSLSVELSNDERPPESRRLAGIILKNSLDAKDSARKELLIQQWVSLDHSIKSQIKESLLITLGSSVGDARQTSSQVIAKIASIEIPRREWQDLIAKLLSNMTQPGASAPLKQATLEALGYVCEEIPPEHLEQDQVNAVLTAVVQGMNQTELSSEVRLAAVKALYNALDFAESNFANEMERTFIMKVICDTAVSKEVEIRQAAFECLVAIASTYYVHLDPYMQTIFNLTANAVKGDEEPVALQAVEFWSTICEEEIELQEEYEGSDDANSTVNYRFIEKALPSLVPMLLETLLKQEEDQEQDDNAWNISMSGGTCLGLIARTVGDAIVPLVMPFVEANITKPDWRCREAATFAFGSILDGPSLEKLAPLVQAGLDFLLNTMNDPNSQVKDTTAWTLGRVFELLHSPCSTNPIISNANLPRIMAVLLESSKDVPNVAEKVCGAIYFLAQGYEDAEPVSSLLTPYLPNVIAALLTAADRSDMTHVRLRASAYEALNEIVRVSNIPETSSIIGQLLQEIMRRLNLTFDHQIFSSGDKEKQSDLQALLCGVLQVIIQKLNSSDAKSIIAQTADQLMLLFLRVFACHSATVHEEAMLAIGALAYATGPDFEKYMPEFLKYLEAGLQNYEEYQVCSISVGVVGDICRALEDKILPFCDGIMTVLLKDLSNSQLNRSVKPPIFSCFGDIALAIGENFEKYLPYAMPMLQGAAELLVVLDQNDEDMVDYGNQLRRGIFEAYSGILQGLKGAKAQLMIPYAGHLLQFTEAVYKDGSRDESVTKAAVAVLGDLADTLGPISKDLFKSHLFHVEFLRECLDLDDEVRETASWTQGMINQAIVS

SEQ ID NO: 597 - DNA, 2619 bp, Oryza sativa
atgtcactggatattactcaagttctcttgagtgcacaatctcctgatggcgcgactaggaagcttgctgaagaaagccttaagcagttccaggagcaaaacctcccaggtttcttgttctccctctcaaatgagttggccaatgaggagaaacctgaggaaagccggaggttggctggcttgattctcaagaatgcactggatgccaaggagcagcacaggaagaatgagcttttccagagatggctggcactagatgttggcgttaaggcacagattaaaggatttcttttgcaaactctctcatctcctgttgcaagtgccagatctacctcttctcaagttatcgcaaaggttgctggaattgagattccacagaagcaatggcctgaacttattgcgtcgttgctctcaaacatacatcaggtccagccaaatgtcaagcaagcgacgcttgagacacttggctacttatgtgaagaagtttctccagaagctgttgaccaagaccaagtcaataaaattcttactgctgttgttcagggtatgaatgcttctgaagggaattctgatgtgaggcttgcagcaacacgggcattgtataatgcattgggctttgctcaggttaacttctccaacgacatggaacgtgattatatcatgagagttgtttgtgaagcaactcagtccactgatgtgaagataaggcaggctgccttcgagtgcttggtggctatctcatccacttattatgacaagctggctacgtacatgcaggacatatttaatattactgctaaggctgttaggggagatgaggagtcagttgcactccaggccattgaattttggagctccatatgtgatgaggaaattgacattttggatgagtacagtagtgagtttacagctgactctgatgttccttgctactattttatcaagcaagcacttcctgccttagtgccaatgctgctagagaccctcctcaagcaggaggaagaccaagacttggatgaaggtgcttggaatcttgcaatggctgggggtacttgtttgggccttgtggcgagaactgttggggatgatattgtacctcttgtgatgccttttgttgaggagaacataacaaagcctgattggaggcacagggaggctgcaacatatgctttcggttccattttggagggcccatcagctgataaacttgctcctcttgttaatgtcgcattgaattttatgttgtctgcactggtgaatgacccaagtaaccatgtgaaggacacaactgcttggacccttggaagaatatttgagtttcttcatggttctgcacttgaaactgctcctattatcacatctgagaactgtcagcaaatacttaccgtgcttcttcaaagcatgaaggatgtcccaaatgtggcagagaaggcatgcggagcactctatttccttgctcaaggctatgtggatgcaggatccgcttcgccgctaactcccttcttccaagatattattcagagccttctctttgttactcatagggaagatgctggagaatccagattgcgtactgcagcttatgaaactctaaatgaagttgtcagatgctccattgaagaaacaggccctattgttatgcagttggtacctgtgatcatgatggagctccatcagacacttgaggcaggaaagttatcaactgatgagagggagaagcggagcgaactgcagggccttctctgtggttgtttgcaggtcataatccagaagttgggagcgatggagtcaacaaaatattccttcttgcaatatgccgatcaaatgatggaactgtttttgagagtttttgcctgtcgaaacgccactgtgcatgaggaggctatgcttgctattggtgcattggcatatgcggcaggtccaaacttttcgaagtacatgcctcagttttatcagtatttggagatgggactacagaactttgaggagtatcaggtctgtgccattaccgtgggtgttgtgggtgatttgtgcagggcactggaggacaaaattctgccttactgtgatggaatcatgacccaactcctgaaggacttgtcgagcaatcagttgcatagatctgtaaagccacctatattctcatgctttggcgatattgcactggcaattggggagaactttgagaagtatttgatatatgccatgcccatgctacaaagtgcagcagatttgtcggcgcatgctgctgcagctgatgatgaaatgctcgattacaccaaccaattaaggaatggaatactggaagcatactctggtattcttcaaggatttaagagctcccctaagacacaattactgatgcagtatgctcccaatattcttaatttccttgatgctctttacaatgggaaggatatggatgatactgtgatgaagactgcgataggtgtactgggagatctcgcggacacgttgggtgtccatgctggccctttgatcaatcaatctatctcaagcaagaaatttttggaggagtgcttagcatctgatgatccactggtcaaagagtcagctgattgggcaagggttgcaatcagccgtgcggtttcaggttga

SEQ ID NO: 598 - protein, 872 aa, Oryza sativa
MSLDITQVLLSAQSPDGATRKLAEESLKQFQEQNLPGFLFSLSNELANEEKPEESRRLAGLILKNALDAKEQHRKNELFQRWLALDVGVKAQIKGFLLQTLSSPVASARSTSSQVIAKVAGIEIPQKQWPELIASLLSNIHQVQPNVKQATLETLGYLCEEVSPEAVDQDQVNKILTAVVQGMNASEGNSDVRLAATRALYNALGFAQVNFSNDMERDYIMRVVCEATQSTDVKIRQAAFECLVAISSTYYDKLATYMQDIFNITAKAVRGDEESVALQAIEFWSSICDEEIDILDEYSSEFTADSDVPCYYFIKQALPALVPMLLETLLKQEEDQDLDEGAWNLAMAGGTCLGLVARTVGDDIVPLVMPFVEENITKPDWRHREAATYAFGSILEGPSADKLAPLVNVALNFMLSALVNDPSNHVKDTTAWTLGRIFEFLHGSALETAPIITSENCQQILTVLLQSMKDVPNVAEKACGALYFLAQGYVDAGSASPLTPFFQDIIQSLLFVTHREDAGESRLRTAAYETLNEVVRCSIEETGPIVMQLVPVIMMELHQTLEAGKLSTDEREKRSELQGLLCGCLQVIIQKLGAMESTKYSFLQYADQMMELFLRVFACRNATVHEEAMLAIGALAYAAGPNFSKYMPQFYQYLEMGLQNFEEYQVCAITVGVVGDLCRALEDKILPYCDGIMTQLLKDLSSNQLHRSVKPPIFSCFGDIALAIGENFEKYLIYAMPMLQSAADLSAHAAAADDEMLDYTNQLRNGILEAYSGILQGFKSSPKTQLLMQYAPNILNFLDALYNGKDMDDTVMKTAIGVLGDLADTLGVHAGPLINQSISSKKFLEECLASDDPLVKESADWARVAISRAVSG

SEQ ID NO: 599 - DNA, 2625 bp, Physcomitrella patens
atggcgctggaggtgacgcaaatactgcttaacgcccagtctcctgatgggacggtcaggaagattgcagaggataatcttaagcaattccaggagcacaacctttctgcttttttggtatctctatctcatgaacttgccaataatgataaacctcccgaaagccgaaggcttgccggtttgatacttaaaaactccttggatgctaaggagagtgctcgaaagcaagaacttgtgacgagatgggtggcgttggatccaagcgtgaaggcgcaaatcaagactgctctttctcaaacccttgcctcagtggttgcggatgctcgtcatacttccgcgcaggttattgccaagattgctgctatcgagctgcctcagggcgaatggcccgagctggttgggtcattgttggcaaatatgggaggtcctcaaatggagcaacccgcgcatctgaagcaagcgacactagaagcccttgggtacgtatgtgaggaggtttcagccgacatcctggctcaggagcaggtgaactcaatactgactgccgttgtccagggcatgaactcgtccgagactagcaacgatgtccgacttgctgccacacacgctctgtataatgcccttgatttcgctcaaaccaacttcgaaaacgatatggagcgcgactatattatgagggtggtctgcgaagctactctctcaccagatgtcagagtccgccaggctgcctttgaatgcctggtctcgattggatccacctattatgacaagcttgcaccgtacatgcaagatattttcgcaatcacgtccaaagcagttagggaggatgaggagccagttgcccttcaagctactgaattttggagttccatctgtgatgaagagatcgagattcaggaagaatacagtgctgatttctctggagattcggaggtgccatacttccagttcatcaagcaggccttgcctgcccttgtcccactgttgttggaaactttgacaaagcaagaggaagatcaggacttggaagagggagcttggaacttgtccatggccggtgggacatgtttgggtttggtggctcgcaccgtcggggacgacgttgtgcctcttgttatgcctttcgtccaagagaacgtctcgaagcctgattggaggtgtcgggaagcagctacgtacgcctttggatccattcttgaggggccatctctagacaagctaaccccccttgtgaatgtggccctcaccttcatgctgaacgcaatgaaagattcgaacaaccatgttaaggatactactgcatggacgttaggaaggatcttcgagttccttcacggtccctcaattgaaactccagttatcaaccaaaccaacttgcacttgatacaggctgttcttctcgagagtattaaggacactcctaatgtggcggagaaagtctgtggagcaatctatttcttggcacaaggctatgaggaaagtggacagacatcctctccattatctcctttcttccagagcattgttcaagctctgctcgccactactgagcgggaggatagcggagattctcgactgcgaacatctgcatatgaaactctgaacgaagttgttagaatctcaacggaggatactgcttcgattgtcgtgcagctggtgcctgtgattatgcagaaactcaatcacactttagaaatggctgtcctctcgtctgacgaccgggagaagcagagcgaactgcaggctcttctgtgtggtgttctgcaggtcatcatccagaaattgggtgcatctgaaacgaccaagtatggcatcgtgcagtacgccgatcaaatgatgggtttgttccttcgtgttttcgcttgccgcagtgcaactgttcatgaagaagctatgcttgcgatcggagctcttgcatatgctacaggggctgagtttggaaaatacatgggcgagttttaccgttacttggaaatgggtctccaaaactttgaagaatatcaggtatgtgcagtaactgttggtgtagtcggtgacatttgtcgtgctctggaggagaaggttcttccttactgcgatggaatcatgacccagcttctgaaggacttgtccagcaatcagttgcatcgctcagtgaaaccacccattttctcgtgctttggggacattgccctggcaattggagagcactttgagaagtatctgatttacgcgatgccaatgcttcaaggagctgcggagctatctgctcaaccgtcaggtagtgacgatgaaatgattgaatacaataatcaactccgcagtggcattttcgaggcttactctggtattttccaaggatttaaatctaacaaggcggagctgatggcaccatacgctggacatattctgcaatttattcagaatgtgtatcatgacaaagacagggacgaagtggtaactaaggctgctattggagtcatgggtgatttggctgacactttgggggctagctctgccgctttgttccaacgtacagtattcttcaaagactttcttgatgaatgtacttcgtcggatgaccagcagctgaaagagacagcggagtgggcccagggcactatctcacgcatattatctggttga

SEQ ID NO: 600 - protein, 874 aa, Physcomitrella patens
MALEVTQILLNAQSPDGTVRKIAEDNLKQFQEHNLSAFLVSLSHELANNDKPPESRRLAGLILKNSLDAKESARKQELVTRWVALDPSVKAQIKTALSQTLASVVADARHTSAQVIAKIAAIELPQGEWPELVGSLLANMGGPQMEQPAHLKQATLEALGYVCEEVSADILAQEQVNSILTAVVQGMNSSETSNDVRLAATHALYNALDFAQTNFENDMERDYIMRVVCEATLSPDVRVRQAAFECLVSIGSTYYDKLAPYMQDIFAITSKAVREDEEPVALQATEFWSSICDEEIEIQEEYSADFSGDSEVPYFQFIKQALPALVPLLLETLTKQEEDQDLEEGAWNLSMAGGTCLGLVARTVGDDVVPLVMPFVQENVSKPDWRCREAATYAFGSILEGPSLDKLTPLVNVALTFMLNAMKDSNNHVKDTTAWTLGRIFEFLHGPSIETPVINQTNLHLIQAVLLESIKDTPNVAEKVCGAIYFLAQGYEESGQTSSPLSPFFQSIVQALLATTEREDSGDSRLRTSAYETLNEVVRISTEDTASIVVQLVPVIMQKLNHTLEMAVLSSDDREKQSELQALLCGVLQVIIQKLGASETTKYGIVQYADQMMGLFLRVFACRSATVHEEAMLAIGALAYATGAEFGKYMGEFYRYLEMGLQNFEEYQVCAVTVGVVGDICRALEEKVLPYCDGIMTQLLKDLSSNQLHRSVKPPIFSCFGDIALAIGEHFEKYLIYAMPMLQGAAELSAQPSGSDDEMIEYNNQLRSGIFEAYSGIFQGFKSNKAELMAPYAGHILQFIQNVYHDKDRDEVVTKAAIGVMGDLADTLGASSAALFQRTVFFKDFLDECTSSDDQQLKETAEWAQGTISRILSG

SEQ ID NO: 601 - DNA, 2628 bp, Physcomitrella patens
atggcgctggaggtaacacagatacttttaaacgctcagtctcctgatggaacggtcaggaagattgccgaggataaccttaagcagtatcaagagcagaatctctctgcctttttggtatctctatctcatgaacttgccaatgatgataagccgcctgagagtcgaaggctggctggtttgatcctcaaaaactcgctggatgctaaggaaagttctcggaagcacgaactcgtgacaagatgggtggccttagactctactgtgaaggctcaaatcaagcctgctctttctcaaactctctcctccatggtggcggatgctcgtcacacagctgcgcaagttatcgctaagattgctgctattgaactgcctcagggcgattggcctgagcttgtggggtcacttttggccaacatggggggccctcaagtagagcaaccctcacatctgaaacaggcaacactagaagctcttggctatgtctgcgaggaggtttctgcggagatccttgctcaagagcaggtgaattctatcctgactgctgtggtccagggaatgaactcatccgagacgagtaacgacgtccgacttgcagccactcacgctctgtacaatgctcttgacttcgcgcaaacgaatttcgagaacgacatggaacgtgactacatcatgaggatggtttgtgaggccacgctctcacctgatgttcgagttcgtcaggccgcatttgaatgtttagtatccattggatctacgtactatgacaagctcgcaccgtacatacaagacattttcgccatcacttctaaggcagtcaaggaagatgaggagccggttgcacttcaagccatcgagttttggagctctatttgtgacgaagaaattgagattcaggaagattacaatgttgatttttctggtgactcggaggtgccgtatttccagttcatcaaacaggcattgcctgctttagtccctatgttgttagaaactcttacaaaacaagaagaggaccaggatttggatgaaggggcgtggaacttgtccatggccggtgggacgtgtctgggtctggtcgctcgtgccgtcggggacgatattgtgcctctggtcatgccctttgtagaacaaaatgtctcaaatccattggattggagatgtcgtgaggcggccacatacgcttttggttccattcttgagggtccttctttggacaagctgactcctcttgtaaatcttgcgctcaacttcatgttgagtgcaatgaaagatgtaaataatcacgtcaaggatactacagcatggacgttgggaaggatctttgagttccttcatggaccttcgcttgagcctccagttatcaccccaaccaatctgcccttgatcattgctgtgcttctcgagagcatcaatgatacacctaacgtggctgagaaggtttgtggagcaatttatttcctggcacagggttatgaggacggtgggcagtcatccactcctctttctccttacttcccgaaaatcctggaagctttgttggctgcgacggcgagagaggacagcgtagactctcggcttcgaacttgtgcatatgagactctaaacgaagttgtgagaatatcaacggatgacactgccccaatcgttgtgcagttagtgcctgtgattatggagaaactcaatcaaactttggaaatggccgtgctttcttctgacgatcgggagaagcagattgaactgcaggctcttctctgtggtgttctccaggtcatcattcaaaagttgggtgcatctgagctcacaaagtacggcgtcgtacagtttgccgatcagatgatgggtctgttcctccgcgtctttgcttgccgaagtgccacagtccacgaggaagctatgcttgcaatcggagctttggcatatgcaacgggtgctgaattcggaaaatacatgagcgaattttaccggtacttggaaatgggtcttcaaaactttgaagaatatcaggtgtgtgctgttacagttggtgtggtcggggatatctgtcgcgccttggacgagaaggtgctcccctactgtgatggaattatgacccagcttctgaaggacttatcaagcaatcagttgcatcgctcagtgaagccacccattttctcatgcttcggggatatcgccctggctatcggggagcactttgagaaatatttgatttacgcaatgcccatgctccaaggagctgcagagctttctgcccaacctacagctggtgatgatgaaatgaccgattacagtaaccagctacgcagtggtattttggaggcatactccggtattttccaaggtttcaagtcaaacaaggcggacttgatggcaccttatgctgcgcatattctgcaatttattgagaacgtttatcaggacaaagacagggatgatgtggtgacgaaggctgcaattggagttatgggtgatttggctgatacgcttggagccaatgctgcggctttgtttcaatgtacagtattctataaagacttccttgatgaatgcatttcttcagatgaccagcagctgaaagagacagctgagtgggctcagggcacaatcacacgcattctatctggttga

SEQ ID NO: 602 - protein, 875 aa, Physcomitrella patens
MALEVTQILLNAQSPDGTVRKIAEDNLKQYQEQNLSAFLVSLSHELANDDKPPESRRLAGLILKNSLDAKESSRKHELVTRWVALDSTVKAQIKPALSQTLSSMVADARHTAAQVIAKIAAIELPQGDWPELVGSLLANMGGPQVEQPSHLKQATLEALGYVCEEVSAEILAQEQVNSILTAVVQGMNSSETSNDVRLAATHALYNALDFAQTNFENDMERDYIMRMVCEATLSPDVRVRQAAFECLVSIGSTYYDKLAPYIQDIFAITSKAVKEDEEPVALQAIEFWSSICDEEIEIQEDYNVDFSGDSEVPYFQFIKQALPALVPMLLETLTKQEEDQDLDEGAWNLSMAGGTCLGLVARAVGDDIVPLVMPFVEQNVSNPLDWRCREAATYAFGSILEGPSLDKLTPLVNLALNFMLSAMKDVNNHVKDTTAWTLGRIFEFLHGPSLEPPVITPTNLPLIIAVLLESINDTPNVAEKVCGAIYFLAQGYEDGGQSSTPLSPYFPKILEALLAATAREDSVDSRLRTCAYETLNEVVRISTDDTAPIVVQLVPVIMEKLNQTLEMAVLSSDDREKQIELQALLCGVLQVIIQKLGASELTKYGVVQFADQMMGLFLRVFACRSATVHEEAMLAIGALAYATGAEFGKYMSEFYRYLEMGLQNFEEYQVCAVTVGVVGDICRALDEKVLPYCDGIMTQLLKDLSSNQLHRSVKPPIFSCFGDIALAIGEHFEKYLIYAMPMLQGAAELSAQPTAGDDEMTDYSNQLRSGILEAYSGIFQGFKSNKADLMAPYAAHILQFIENVYQDKDRDDVVTKAAIGVMGDLADTLGANAAALFQCTVFYKDFLDECISSDDQQLKETAEWAQGTITRILSG

SEQ ID NO: 603 - DNA, 2613 bp, Populus trichocarpa
atggcattggagatcactcagtttctattggctgcccaatcaccggatgcaaatatccgtactcaggcagaggccagtcttaggcagttccaagagcagaacttgccccttttccttctatccttgtcagtggagcttgcaaacaatgtaaagcctttagaatcacgtagattggctggtattgttcttaaaaactctttagatgctaaagattctgtgagaaaggaacatcttgttcaacaatggatgacaattgaaatttctatcaaatcacaaatcaaagactcactcttgagaactcttgggtcatctgcatcggaagcaaggcacacttctgcccaagtaattgcaaaagttgcttccattgagattccacggaagcagtggcctgagctcatcggatcattgcttaataatatgacccagcaagatagtccggcagctttgaaacaggcgaccctggaaactcttggatatgtttgtgaggtgatatcgcatcaggatcttgtgcaggatgaagttaactctgttctcactgctgttgtccaaggcatgaaccttgctgaacacagtcatgaagtacgtattgcagcaacaaaggccttgtataatgccttagattttgcccagaccaactttgacaatgaaatggagcgcaattacatcatgaaggtggtatgtgaaacagcaatttccaaagaggcggatatcaggcaggctgctttcgagtgtcttgtttctatagcatcaacatactatgaggtgcttgaaccttatatgcagaccctcttccagctaacatcaaatgctgtaaaaggggatgaagagagtgttgccctccaagcaattgaattctggagctccatctgcgatgaagagatagagcttcaagaatatgggactgttgaaggtggggattctgggtctgctcattcacgcttcatagaaaaggccctcccatatcttgttcctttgttgttggatactatgttgaaacaggaggatcaggatcaggatgatagcatttggaatatatccatggcagggggaacctgtcttggtcttgttgctagaactgttggggattctattgtgaaacttgtaatgccctttgtcgagggtaatattcttaacccagattggcattgtcgcgaggcagccacatatgcatttggctccattctagaaggccctagcgttgaaacattgggtccacttgttactaatggcttggattttctgcttaatgcaataagggatgaaaataataatgtcaaggacacaactgcctggacgcttagtcgtatatttgagtttttgcactgtcctgccagtggattttctgtgatttccccggagaagctggaaagaattgtaactgtcttgctggagagtattaatgatgctccacatgtagctgaaaaggtttgtggggcaatctattaccttgcacagggatatgaagattctggaacaagttcctcgcttctaactcaacacatccctaggattatctctgaacttctcaaaactgctgagcggacagatgggagcgactttaagctcaggacttctgcttatgagacattgaacgaggttgttaggtcttccaatgttgtggaaacatcactaattattttggagctgctcaaaagcatcttgcataagttggggcagactctagagcttcaaattgtctcatcagatgatagagagaagcaaggggacttgcaagcttccctttgtgctgttatccaggtgatcatccaaaagcttagcagcactgatgagactaagcccagtacacttcaggcagcagatccaattatgattctgctcctcagggtttttgcttgccgcagctctactgtgcatgaggaagcaatgcttgcaatcggtgcactggctcatgcctctggtccagaattcgagaagtatatgcctgagttatacaaatacctggagatgggactacagaattttgaggagtacgaggtttgtgccatcacagttggggtgattggtgacatttgccgcgcactggaggacaaggttttaccatactgtgatgggatcatgaaccaccttgtctgcaatctccaaagtgctgaactcaaccggtcggtcaagcctcccatattctcctgctttggggacattgctcttgctataggcgagcaattctctaagtacattgagcctacagtagcaatgatgcggagtgctgctgaggtctgtgctcagatggataatagtgatgaggagttgatggattatggcaaccagcttaagcgtagcatatttgaagcttattctggtattcttcagggattcaaagattccaagcctgagttgatgctgccacatgctggtcaccttttccagttcatagaattggttttcagagagaaatatagggatgagagtgttacaaaagcagcagttgcggtgatgggtgatctggcagatgcccttggtccaaacacgaaaatactgtttaaagacaaagcattctgcgttcaattcctcggcgagtgtcttcaatctgaagatgaacatctcaaagagactgcaaattggacccaagtgatgattgctcgtgttgtttcatga

SEQ ID NO: 604 - protein, 870 aa, Populus trichocarpa
MALEITQFLLAAQSPDANIRTQAEASLRQFQEQNLPLFLLSLSVELANNVKPLESRRLAGIVLKNSLDAKDSVRKEHLVQQWMTIEISIKSQIKDSLLRTLGSSASEARHTSAQVIAKVASIEIPRKQWPELIGSLLNNMTQQDSPAALKQATLETLGYVCEVISHQDLVQDEVNSVLTAVVQGMNLAEHSHEVRIAATKALYNALDFAQTNFDNEMERNYIMKVVCETAISKEADIRQAAFECLVSIASTYYEVLEPYMQTLFQLTSNAVKGDEESVALQAIEFWSSICDEEIELQEYGTVEGGDSGSAHSRFIEKALPYLVPLLLDTMLKQEDQDQDDSIWNISMAGGTCLGLVARTVGDSIVKLVMPFVEGNILNPDWHCREAATYAFGSILEGPSVETLGPLVTNGLDFLLNAIRDENNNVKDTTAWTLSRIFEFLHCPASGFSVISPEKLERIVTVLLESINDAPHVAEKVCGAIYYLAQGYEDSGTSSSLLTQHIPRIISELLKTAERTDGSDFKLRTSAYETLNEVVRSSNVVETSLIILELLKSILHKLGQTLELQIVSSDDREKQGDLQASLCAVIQVIIQKLSSTDETKPSTLQAADPIMILLLRVFACRSSTVHEEAMLAIGALAHASGPEFEKYMPELYKYLEMGLQNFEEYEVCAITVGVIGDICRALEDKVLPYCDGIMNHLVCNLQSAELNRSVKPPIFSCFGDIALAIGEQFSKYIEPTVAMMRSAAEVCAQMDNSDEELMDYGNQLKRSIFEAYSGILQGFKDSKPELMLPHAGHLFQFIELVFREKYRDESVTKAAVAVMGDLADALGPNTKILFKDKAFCVQFLGECLQSEDEHLKETANWTQVMIARVVS

SEQ ID NO: 605 - DNA, 2616 bp, Populus trichocarpa
atggcaatggaagtgacccaggtgcttttgaatgcccaatctatagatgggaatgtgcggaagcatgcagaagaaagcttaaaacagtttcaggagcaaaacctgcccagttttttgctctctctctccggagagctagctaatgatgagaagcctgttgacagtcgtaaattagcaggtttaattcttaaaaatgcgttggatgcaaaggaacagcatagaaagcttgagcttgttcaaagatggttgtcgctggacaacaatgcaaagggtcaaattaaggcatgtttgttgaagacacttgcttctcctgtaccagatgcacggtcaactgcatctcaagttattgccaagattgcagggattgagttgcctcagagacagtggccagagctgattggatcacttttatccaatattcatcagttacctgctcatgtcaagcaagctactttagagactcttggatatttgtgtgaggaagtctcacctgatgttgtagatcaagaccatgtaaacaagatacttacagcagtagtacagggcatgaacgcaactgaaggaaacaatgatgttaggcttgctgcaacccgagcactgtacaatgcacttggatttgctcaggcaaacttcagcaatgatatggagcgtgattatatcatgagagtggtctgcgaggcaactttatccccagaaatgaagataagacaagctgcttatgagtgtctggtctctatttcatcaacatactatgagaaattggctccttatatgcaggatatctttaacatcacggcgaaggccgtgagggaagatgaagaacctgtagcccttcaagcaattgaattctggagttcaatatgtgatgaggagatagatatcttggaagaatatgggggtgatttcactggggattctgatgttccttgcttttactttattaagcaggctctccctgctttggtcccaatgttgttggagactctcctaaagcaagaggaggatcaggatcaagatgaaggagcttggaatattgcaatggctggtggaacatgccttggtttggttgcaaggactgtgggagatgatattgtgcagcttgttatgcaattcattgaagataacattacaaaaccagattggaggcatagagaggcagctacttatgcatttggctcgatcttggaaggtccttcccctgagaaactaacgcctcttgttaatgttgctttgaacttcatgctgactgctttgacaaaggatccaaataaccatgtgaaggatacaactgcttggacccttggtcgaatctttgaattcctccatggttcaactgtggatacaccgataattactcaagcaaattgccaacaaattgtcacggtactactccagagcatgaaggacgttgccaatgtagcagagaaggcatgtggtgccctctatttccttgcccagggttatgaagaggtgaccccatcatcacctcttactccttacttccaggaaattgtccagacacttctctttgttacccacagagaggatgctggggagtcccgattaaggactgctgcatatgaaacgttgaatgaggtggtgagatgctcgactgatgaaacagcaccaatggtgctgcaactggttcctgtcatcatgacggagcttcacaatactcttgaagggcagaagctttcttctgatgagagagagaagcagggtgaattgcaagggcttctctgtggttgcttacaggtcataattcagaagttaggctcctctgagccaactaagtatgtgttcatgcaatatgtagatcagattatggggctcttcctgagggtctttgcttgtagaagtgcaactgtgcatgaggaggccatgttagccataggagcccttgcctatgcaactggtcctgattttgcaaaatacatgccagagttttacaagtacctagaaatgggccttcagaattttgaggagtaccaagtctgtgctgtgactgtcggtgtggtgggtgatatctgcagggcattggaagataaaattttgccttactgtgatggtattatgactcagcttctcaaggatttatcaagcaaccagctgcatagatctgtgaagcctcctattttctctagctttggcgacattgccctggcaataggagagaattttgagaagtacttgatgtatgccatgccaatgctgcaaagtgccgcagagttgtctgcccacacatctgttgctgacgatgaaatgactgaatacacaaattctttgagaaatggaattttggaggcatactctggaattcttcaagggtttaagaattctcctaaaactcagctcttgattccttatgcacctcacatcctgcagttcttggatagcatgtacatggagaaagacatggatgatgtcgttatgaaaactgcaattggagtcctgggagatttagcagatacactgggaagtaatgctggctctttgatacagcaatctctttctagcaaagactttttaaatgaatgtttgtcttctgatgaccatatgattaaggaatctgctgaatgggccaagttggccatcagtcgtgccatttctgtttga

SEQ ID NO: 606 - protein, 871 aa, Populus trichocarpa
MAMEVTQVLLNAQSIDGNVRKHAEESLKQFQEQNLPSFLLSLSGELANDEKPVDSRKLAGLILKNALDAKEQHRKLELVQRWLSLDNNAKGQIKACLLKTLASPVPDARSTASQVIAKIAGIELPQRQWPELIGSLLSNIHQLPAHVKQATLETLGYLCEEVSPDVVDQDHVNKILTAVVQGMNATEGNNDVRLAATRALYNALGFAQANFSNDMERDYIMRVVCEATLSPEMKIRQAAYECLVSISSTYYEKLAPYMQDIFNITAKAVREDEEPVALQAIEFWSSICDEEIDILEEYGGDFTGDSDVPCFYFIKQALPALVPMLLETLLKQEEDQDQDEGAWNIAMAGGTCLGLVARTVGDDIVQLVMQFIEDNITKPDWRHREAATYAFGSILEGPSPEKLTPLVNVALNFMLTALTKDPNNHVKDTTAWTLGRIFEFLHGSTVDTPIITQANCQQIVTVLLQSMKDVANVAEKACGALYFLAQGYEEVTPSSPLTPYFQEIVQTLLFVTHREDAGESRLRTAAYETLNEVVRCSTDETAPMVLQLVPVIMTELHNTLEGQKLSSDEREKQGELQGLLCGCLQVIIQKLGSSEPTKYVFMQYVDQIMGLFLRVFACRSATVHEEAMLAIGALAYATGPDFAKYMPEFYKYLEMGLQNFEEYQVCAVTVGVVGDICRALEDKILPYCDGIMTQLLKDLSSNQLHRSVKPPIFSSFGDIALAIGENFEKYLMYAMPMLQSAAELSAHTSVADDEMTEYTNSLRNGILEAYSGILQGFKNSPKTQLLIPYAPHILQFLDSMYMEKDMDDVVMKTAIGVLGDLADTLGSNAGSLIQQSLSSKDFLNECLSSDDHMIKESAEWAKLAISRAISV

SEQ ID NO: 607 - DNA, 2616 bp, Populus trichocarpa
atggcgatggaagtgacccaggtgctattgaatgcccaatctatagacgggaatgtgcggaagcatgcggaagaaagcttaaaacagtttcaggagcaaaacctgcctggttttttgttctccctctctggagagctagcaaatgatgagaagcctgttgatagccgtaaattagcaggcttaatacttaaaaatgcattggatgcaaaggaacaacatagaaagctcgagcttgttcaaagatggttgtcgttggacaacaatgttaagggtcaaattaaggtgtttttgttgaagacccttgcttctcctgtaccggatgcacggtcaactgcatctcaagttattgctaagattgctgggattgagttgcctcagcgacaatggccggagctgataggatcacttttatctaatattcatcagttacctgctcatgtcaagcaagctactttagagactcttggatatttgtgtgaggaagtctcacctgatgttgtagatcaagaccatgtaaacaagatacttacagcagtagttcagggcatgaatgcatctgaaggaaacaatgatgttaggcttgctgcaacccgagcactgtacaatgcacttggatttgctcaagcaaatttcagcaatgatatggagcgtgattatatcatgagagtggtctgcgagtcaacactgtccccagaagtgaagatacgacaggctgcttttgagtgtttggtctctatttcatcaacatattatgagaaattggctccttatattcaggatatctttaacatcacagcaaaagctgtgagggaagatgatgaacctgtagctcttcaagcaattgaattctggagttcaatatgtgatgaggagatagatatcttggaagaatatgggggtgatttcactggggattctgagattccttgcttttactttattaagcaggctctccctgctctggtccctatgctgttggaaactcttcttaagcaagaggaggatcaggatcaagatgaaggagcttggaatattgcaatggctggcggaacatgccttggtttggttgcaaggactgtgggagatgatattgtgcaacttgttatgccattcattgaagagaacattacaaaaccagattggaggcaaagggaggcagcgacttatgcatttggctcaatcttggagggtccttcccctgacaagctaacacctcttgttaatgttgcattgaacttcatgcttactgcattgaccaaggatccaaataaccatgtgaaggatacaactgcttggacccttggtcgaatctttgaattccttcatggttcaactgtggatacaccaataattactcaggcaaattgccaacaaattgtcactgtgctacttcagagcatgaaggacgttgccaatgtagcagagaaggcatgtggtgccctctatttccttgcccagggttatgaagaggtgagcccatcatctccccttactccttacttccaagaaattgtccaggcacttctcactgttacccacagagaagatgctggcgagtcccgattaaggactgctgcatatgaaacgttgaatgaggtggtgaggtgctcaactgatgaaaccgcacctatggtgctgcaactggttcctgtcatcatgatggagcttcacaatactcttgaagggcagaagctttcttctgatgagagagagaagcagggtgaattgcaagggcttctctgtggttgcttacaggtcataattcagaagttaggctcctctgagccaactaagtatgtgttcatgcaatatgcagaccagataatgggactcttcctgagggtttttgcttgtagaagtgcaacagtgcacgaggaggccatgttggctattggagcccttgcctatgcaactggtccagattttgccaaatacatgccagagttttacaagtacttagaaatgggccttcagaattttgaggagtaccaagtctgtgcggttactgttggtgtggtgggggatatttgcagggcattggaagataaaactttgccttactgtgatggtattatgactcagcttctcaaggacttatcaagtaaccagttgcatagatctgtgaagcctcccattttctctagctttggcgacattgccctggcaataggagagaattttgagaagtacttgatgtatgccatgcccatgctgcagagcgctgctgagttgtctgcccacacagctgatgctgatgatgaaattactgagtacacaaattctttgagaaacggaattttggaggcatattctggaattcttcaaggttttaagaattctcctaaaactcagctcttgattccttatgcacctcacatcctgcagttcttggatagcatgtacatggagaaagacatggatgatgtggtgatgaaaactgctattggagtccttggagatttagcagatacactgggaagtaatgctggttctttgatacagcaatctctctctagcaaagactttttaaatgaatgtttgtcttctgatgatcatatgattaaggaatctgccgaatgggccaagttggccatcagtcgtgccatttcagtttga

SEQ ID NO: 608 - protein, 871 aa, Populus trichocarpa
MAMEVTQVLLNAQSIDGNVRKHAEESLKQFQEQNLPGFLFSLSGELANDEKPVDSRKLAGLILKNALDAKEQHRKLELVQRWLSLDNNVKGQIKVFLLKTLASPVPDARSTASQVIAKIAGIELPQRQWPELIGSLLSNIHQLPAHVKQATLETLGYLCEEVSPDVVDQDHVNKILTAVVQGMNASEGNNDVRLAATRALYNALGFAQANFSNDMERDYIMRVVCESTLSPEVKIRQAAFECLVSISSTYYEKLAPYIQDIFNITAKAVREDDEPVALQAIEFWSSICDEEIDILEEYGGDFTGDSEIPCFYFIKQALPALVPMLLETLLKQEEDQDQDEGAWNIAMAGGTCLGLVARTVGDDIVQLVMPFIEENITKPDWRQREAATYAFGSILEGPSPDKLTPLVNVALNFMLTALTKDPNNHVKDTTAWTLGRIFEFLHGSTVDTPIITQANCQQIVTVLLQSMKDVANVAEKACGALYFLAQGYEEVSPSSPLTPYFQEIVQALLTVTHREDAGESRLRTAAYETLNEVVRCSTDETAPMVLQLVPVIMMELHNTLEGQKLSSDEREKQGELQGLLCGCLQVIIQKLGSSEPTKYVFMQYADQIMGLFLRVFACRSATVHEEAMLAIGALAYATGPDFAKYMPEFYKYLEMGLQNFEEYQVCAVTVGVVGDICRALEDKTLPYCDGIMTQLLKDLSSNQLHRSVKPPIFSSFGDIALAIGENFEKYLMYAMPMLQSAAELSAHTADADDEITEYTNSLRNGILEAYSGILQGFKNSPKTQLLIPYAPHILQFLDSMYMEKDMDDVVMKTAIGVLGDLADTLGSNAGSLIQQSLSSKDFLNECLSSDDHMIKESAEWAKLAISRAISV

SEQ ID NO: 609 - DNA, 2616 bp, Populus trichocarpa
atggcaatggagatcactcagtttctattggctgcccaatcaccagatgcaaatatccgtactcaggcagaggctagtcttaggcagttccaagagcagagcttgccccttttcctcttatcattgtcagtggagcttgcaaacaatgagaagcctttggaatcacgtaggttggctggtattgttcttaaaaactctttagatgctaaagattctgtgagaaaggaacatcttgttcagcaatggatggcaattgaaatttccatgaaagcacaaatcaaagacttgctcctgaggactcttgggtcatctgcatcagaagcaagacacacttctgcccaagtaattgcaaaagttgcttccattgagattccacggaagcagtggcctgagcttatcggatcattgcttaagaatatgacccagcaagatagtcctgcagctttgaaacaggcaacattggaaactcttggatatgtttgtgaggagatatcccaccaggatcttgtgcaggatgaagtgaactctgttctcactgctgttgtccaaggcatgaaccttgctgaacatagttgtgaagtacgccttgctgctacaaaggccttatataatgccttagattttgctcagaccaactttgaaaatgatatggagcggaattacataatgaaggtggtatgcgagacagcaatttctaaagaggcagatatcaggcaggctgcttttgagtgtcttgtttctatagcgtcaacatactatgatgtgcttgaaccttatatgcagaccctcttccagctcacatcaaatgctgtgaaaggggatgaagagagtgttgccctccaagcaatagaattctggagctccatttgtgatgaagagatagagcttcaagaatatgggacccttgaaggtggagattcggggtctactcattcacgcttcatagaaaaggccctcccatatcttgttcctttgttgttggatactttgttgaaacaggaggaggatcaggatcaggatgatagcatttggaatatatccatgtcagggggcacctgtctaggtcttgttgctagaactgttggggattctgttgtgaaactagtaatgccctttgtagagggtaatattctgaagccagattggcattgtcgtgaggcagccacatatgcatttggctcaattctagaaggccctagccttgaaacattaggtccgcttgtttctaatggcttggattttctgcttaatgcgatgagggatgaaaataatcatgttaaggacacaactgcatgggctcttagtcgtatttttgagtttttgcactgtcctgccagtggattttctgtggtttccccagagaacctggaaaggattgtaactgtcttgctggagagtattaatgatgctccaaatgtagctgagaaggtttgtggggcaatctattaccttgcacagggatatgaagatgctggaacaaattcctcacttctaactcaatacatccctaggataatctctgaacttctcaaaactgctgagcggtcagatgggagcgattctaagatcaggacttctgcttatgaaacattgaacgaggttgttaggtcgtccaatattgtggaaacatctcaaattattttggaactgctcaaaagcgtcttgcataagttggggcagactatagatcttcaaattgtctcatcagacgatagagagaagcaaggggacttgcaagcatccctttgtgctgttatccaggtgattgtccaaaagcttagcagcactgatgagaccaagcccagtatacttcaggctgcagatacaattatgtttctgttcctcagggtttttgcttgccgcagatctactgtgcacgaggaagcaatgcttgcaattggtgcactggctcatgcctctggtccagaatttgagaagtacatgcctgagctatataagtacctggagatgggattacagaattttgaggaatatgaggtttgtgccatcacagttggggtgattggtgacatttgccgtgcattggaggacaaggtcttaccttactgtgatgggatcatgaaccaccttgtccgcaatctccaaagtgctgaactccaccggtcagttaagcctccaatatttgcctgctttggtgatgttgctcttgggataggtgagcaattctctaagtacgttgagcctacagtagcaatgatgcggagcgctgctgaggtctgtgctcagatggacaatagtgatgaggagttgatggattatggcaaccagcttaagcgtagcatatttgaagcttattctggtattcttcagggattcaaagattccaagcctgagttgatgctgccacatgctggtcatcttttccagttcatagaagtggttttcagagagaaatatagggatgagagtgtcacaaaagcagcagttgccgtgatgggtgatctggcggatgctcttggtcctaacacaaagatactgttcaaagacaacgcattctgcattcaatttcttggcgagtgtcttcaatccgacgacgaacatctcaaagagactgcaaactggacccaagtgatgatcgctcgcgttgtttcatga

SEQ ID NO: 610 - protein, 871 aa, Populus trichocarpa
MAMEITQFLLAAQSPDANIRTQAEASLRQFQEQSLPLFLLSLSVELANNEKPLESRRLAGIVLKNSLDAKDSVRKEHLVQQWMAIEISMKAQIKDLLLRTLGSSASEARHTSAQVIAKVASIEIPRKQWPELIGSLLKNMTQQDSPAALKQATLETLGYVCEEISHQDLVQDEVNSVLTAVVQGMNLAEHSCEVRLAATKALYNALDFAQTNFENDMERNYIMKVVCETAISKEADIRQAAFECLVSIASTYYDVLEPYMQTLFQLTSNAVKGDEESVALQAIEFWSSICDEEIELQEYGTLEGGDSGSTHSRFIEKALPYLVPLLLDTLLKQEEDQDQDDSIWNISMSGGTCLGLVARTVGDSVVKLVMPFVEGNILKPDWHCREAATYAFGSILEGPSLETLGPLVSNGLDFLLNAMRDENNHVKDTTAWALSRIFEFLHCPASGFSVVSPENLERIVTVLLESINDAPNVAEKVCGAIYYLAQGYEDAGTNSSLLTQYIPRIISELLKTAERSDGSDSKIRTSAYETLNEVVRSSNIVETSQIILELLKSVLHKLGQTIDLQIVSSDDREKQGDLQASLCAVIQVIVQKLSSTDETKPSILQAADTIMFLFLRVFACRRSTVHEEAMLAIGALAHASGPEFEKYMPELYKYLEMGLQNFEEYEVCAITVGVIGDICRALEDKVLPYCDGIMNHLVRNLQSAELHRSVKPPIFACFGDVALGIGEQFSKYVEPTVAMMRSAAEVCAQMDNSDEELMDYGNQLKRSIFEAYSGILQGFKDSKPELMLPHAGHLFQFIEVVFREKYRDESVTKAAVAVMGDLADALGPNTKILFKDNAFCIQFLGECLQSDDEHLKETANWTQVMIARVVS

SEQ ID NO: 611 - DNA, 2619 bp, Sorghum bicolor
atgtcacttgacgttactcaagttctcttaagtgcgcaatctgctgatggtgcaattaggaagcatgctgaagaaagtcttaagcagttccaggagcagaacctccctggattcttgctttccctctcaagcgagttggccaatgaagagaaacctgaggagagccgaaggttagctggcttgattcttaagaatgcactggatgcaaaggagcagcacaggaagaatgagcttttccagagatggctggcactggatgctggtgccaaggcacaaattaaaggattgttgctgcaaactctcacatctcctgttgcaagtgccagatccactgcttcccaagttattgccaaggttgctggtattgagattccgcagaagcaatggccagagcttataggatcattgcttataaacatacatcaggtccagccaaatgtcaagcaagcaacgcttgagactcttggctatttatgtgaggaagtttctccagatgctgtagaccaagaccaagtcaataaaatacttacagctgttgttcagggtatgaatgcttctgaggcaaactctgatgtgaggcttgcagctacacgggcattgtataatgctttgggctttgctcaggtgaacttctcgaatgacatggagcgtgactatatcatgagagtagtttgtgaagcgacgcagtctccggaggtgaagataaggcaggctgcctttgagtgtttggtggctatatcgtctacttactatgataagctggcaacatacatgcaggatatatttaatataactgcaaaagctgtgaggggagatgaggagtcagtagcactccaggctattgaattctggagttccatatgtgatgaggaaattgacattctggatgagtacagcagtgagtttacagctgattctgatgttccttgctactactttatcaagcaggctcttcctgccttagtgccgatgttgttggaaactctcctcaagcaagaggaagaccaagacttggatgaaggtgcttggaatcttgcaatggctgggggaacttgtttgggcctggtggcaaggactgttggtgatgacattgttcctcttgtaatgcctttcgtggaggagaacataaccaagtctgaatggagacagagagaggctgcaacatatgcctttggctctatcttggagggcccatcagctgataaactggctcctcttgttaatgttgcattgggcttcatgctgtctgcactgacgaaggatcccagtaaccatgtaaaggacacaactgcctggacacttgggagaatctttgagttccttcatggttcagcacttgaaactcctcctatcatcacggctgagaattgtcagcaaatacttactgtgctgcttcacagcatgaaggatgtcccaaatgtggctgaaaaggcatgtggagccctctatttccttgcacaaggctatgtggatgctggatctgcatcgccattatcccctttctttcaagatattgttcagaaccttcttatggtcactcacagggaggatgctggagaatctcggctgcgaacagcagcatatgagaccctaaatgaagttgtcaggtgctccactgaggcagcagcccctattgttatgcagttagtacctgtgatcatggtggagctccatcagacacttgaaactgaaaagctgtcaactgatgagcgggagaagaggagcgaactgcagggcctcctttgtggttgcttgcaggtcattatccaaaagttgggagggatggagtcaactaagtactctttcttgcagtatgctgatcagatgatggatctgtttttgagagtttttgcatgtcgaaatgccacagtgcacgaggaggctatgcttgctattggagcattggcatatgcagctggtccaaactttgcaaagtacatggcacagttttatcagtatttggagatgggacttcagaactttgaggagtatcaggtgtgtgccattaccgtgggcgttgttggtgatctctgcagagcactggaagacaaaattttacccttctgtgatggcatcatgactcagctcctgaaggacctgtccagtaaccagttgcacagatctgtgaagccaccgatattttcttgctttggtgatattgcactggcaattggggaaaactttgagaagtatttgatctatgcgatgcctatgctgcaaagtgctgctgatttgtcggcccataccacagcaactgatgatgagatgctcgactacaccaaccagctaaggaatggaatcttggaagcctactctggtatcctgcaaggattcaagagttcacctaagacacaactactgatgccatatgctccacatattattcagttccttgatgctctgtacaatggaaaggacatggatgatactgtgatgaagactgcaataggtgtcttgggagatctggctgacacattgggtgtccatgctggccctttgatcaatcaatccacctcaagccaggcatttttagaggaatgcttggcatcagatgatccattggtgaaagaatctgccgattgggcaaggatagcaatcagccgtgcagtttcgggttga

SEQ ID NO: 612 - protein, 872 aa, Sorghum bicolor
MSLDVTQVLLSAQSADGAIRKHAEESLKQFQEQNLPGFLLSLSSELANEEKPEESRRLAGLILKNALDAKEQHRKNELFQRWLALDAGAKAQIKGLLLQTLTSPVASARSTASQVIAKVAGIEIPQKQWPELIGSLLINIHQVQPNVKQATLETLGYLCEEVSPDAVDQDQVNKILTAVVQGMNASEANSDVRLAATRALYNALGFAQVNFSNDMERDYIMRVVCEATQSPEVKIRQAAFECLVAISSTYYDKLATYMQDIFNITAKAVRGDEESVALQAIEFWSSICDEEIDILDEYSSEFTADSDVPCYYFIKQALPALVPMLLETLLKQEEDQDLDEGAWNLAMAGGTCLGLVARTVGDDIVPLVMPFVEENITKSEWRQREAATYAFGSILEGPSADKLAPLVNVALGFMLSALTKDPSNHVKDTTAWTLGRIFEFLHGSALETPPIITAENCQQILTVLLHSMKDVPNVAEKACGALYFLAQGYVDAGSASPLSPFFQDIVQNLLMVTHREDAGESRLRTAAYETLNEVVRCSTEAAAPIVMQLVPVIMVELHQTLETEKLSTDEREKRSELQGLLCGCLQVIIQKLGGMESTKYSFLQYADQMMDLFLRVFACRNATVHEEAMLAIGALAYAAGPNFAKYMAQFYQYLEMGLQNFEEYQVCAITVGVVGDLCRALEDKILPFCDGIMTQLLKDLSSNQLHRSVKPPIFSCFGDIALAIGENFEKYLIYAMPMLQSAADLSAHTTATDDEMLDYTNQLRNGILEAYSGILQGFKSSPKTQLLMPYAPHIIQFLDALYNGKDMDDTVMKTAIGVLGDLADTLGVHAGPLINQSTSSQAFLEECLASDDPLVKESADWARIAISRAVSG

SEQ ID NO: 613 - DNA, 507 bp, Arabidopsis thaliana
atggaaggtgtaggatcgagattgagccggacgtcatcgagatacagtggtccggcggcgacggcggtgttcagtggccgtgtaaggaaatggaagaagaagtgggtacgtgtctcaacctcatccgtcggtgttttcagagcatctaaatccaacggtcgtaacaacagcaacaacagtaactcaccacaccatctacttctccataagtggactccacttacctcagcgacggttactgcctccgacgctaatggttccggtgagacagaggagtcgcctaagcgaagattcagatacgctccaattgcgatgcttgagcatagagaaaaagtgatttctaaggattctgaaattgaagagactgaagaattcgacactgaatctccattacctaaagctgttgagctagacatgaacctaacagactcagaccaaactaaggaagcaaaaactggtaatttgaatctgggactgtgtctgaattctgaagggactgaagaatga

SEQ ID NO: 614 - protein, 168 aa, Arabidopsis thaliana; identical to SEQ ID NO: 52

SEQ ID NO: 615 - DNA, 717 bp, Arabidopsis thaliana
atggaaggagttggtgcacggttaggtaggtcctcgacacggtacggaccggcaacggttttcaccggaccggtgaggaagtggaagaagaagtgggtacacgtctctccttcctctaagaaagacaataataatagctcctccggttccgccgctgctgcagcttccgtcgttaacggtggttcgaattctgacggtagtaatggatcgcatttgttgctgtataagtgggcaccattgtctcagaatggtaacggcaatgaagatggtaaaagtgagagtaattctccgagcgaggatacggtggcaacggtggcagaagatcctccacggcggagattcaaatacgttccgatagcagtacttgaggaacagaagaaggaaattacagaaattgaggaagatgataagattgaggaggatgacaagattgatgaggataataaggttgagcaggaagacaaggttgatgaggacaaaactgtagaggagtcgagcgagaagaaagcggaagtggaagtggaggaaaagcctgacatcaatgatgttccgatggaagatattcagcaggttgaagaaaaaatagtacaggatgatgaagaaaaagtagtgcgacaagatttgaacgaaagcactgtggatttaggactgaacttaaatgcaaacgatgctgatgcagaaaacgacccgaaagaggacaagccattagaagaatga

SEQ ID NO: 616 - protein, 238 aa, Arabidopsis thaliana
MEGVGARLGRSSTRYGPATVFTGPVRKWKKKWVHVSPSSKKDNNNSSSGSAAAAASVVNGGSNSDGSNGSHLLLYKWAPLSQNGNGNEDGKSESNSPSEDTVATVAEDPPRRRFKYVPIAVLEEQKKEITEIEEDDKIEEDDKIDEDNKVEQEDKVDEDKTVEESSEKKAEVEVEEKPDINDVPMEDIQQVEEKIVQDDEEKVVRQDLNESTVDLGLNLNANDADAENDPKEDKPLEE

SEQ ID NO: 617 - DNA, 495 bp, Brassica napus
atggaaggcgtagggtcgagattgagccgaacgtcatcgagatacagtggtccggctgcgacggcggttttcagcggccgtgtaaggaagtggaagaagaagtgggtacgtgtctccacgtcaccagtcggcgttttccgagcatctaaatccaacggtcgtagcaacaacaacaacagcagcagcaattctccacaccatctgcttctccataagtggaccccacttccctctgacgctaacggctccggtgagacggaggagccgcctaaacgaagattcaggattgcgatgtttgagcatagggagagagtgggtgctaaggattctgaggttgaagcggaagagactgacgaattcgacaatgattctccattgcctaaagccgttggtctggacatgaacttaactgactccgaccaaactaaggaggcaaaaactcgtcacttgaaactgggactgtgtcttaattctgaagggactgaagaagaatga

SEQ ID NO: 618 - protein, 164 aa, Brassica napus
MEGVGSRLSRTSSRYSGPAATAVFSGRVRKWKKKWVRVSTSPVGVFRASKSNGRSNNNNSSSNSPHHLLLHKWTPLPSDANGSGETEEPPKRRFRIAMFEHRERVGAKDSEVEAEETDEFDNDSPLPKAVGLDMNLTDSDQTKEAKTRHLKLGLCLNSEGTEEE

SEQ ID NO: 619 - DNA, 498 bp, Brassica napus
atggaaggcgtagggtcgagattgagccgaacgtcatcgagatatagtggtccggctgcgacggcggtgttcagcggccgtgtaaggaagtggaagaagaagtgggtacgtgtctccacgtcaccagtcggcgttttccgagcatctaaatccaacggtcgtagcaacaacaacagcagcagcaattccccacaccatctgcttctccataagtggactccactttcctccgaagctaacggttccggtgagacggaggagacgcctaaacgaagattcagatacgctcctattgcgatgtttgagcatagggagagagtgggtgctaagggttctgaggttgaagcggaagagactgacgaattcgacaatgattctccattgcctaaagccgttgggctggacatgaacttaactgactcagaccaaactaaggaggcaaaaactcgtcacttgaaactgggactgtgtcttaattctgaagggactgaagaatga

SEQ ID NO: 620 - protein, 165 aa, Brassica napus
MEGVGSRLSRTSSRYSGPAATAVFSGRVRKWKKKWVRVSTSPVGVFRASKSNGRSNNNSSSNSPHHLLLHKWTPLSSEANGSGETEETPKRRFRYAPIAMFEHRERVGAKGSEVEAEETDEFDNDSPLPKAVGLDMNLTDSDQTKEAKTRHLKLGLCLNSEGTEE

SEQ ID NO: 621 - DNA, 492 bp, Brassica napus
atggaaggcgtagggtcgagactgagccggactacaagatacagtggtccgtccgcgacggcggttttcaacggtcgtgtaaggaagtggaagaagaagtgggtaagtgtctcgacttcatccgtcggcattttccgagcatctaagcccaacggtcgaagcacttctcaacaccatatgcttctccacaagtggaccccactttcctcggcgacggttacagcctccggtgagacggaggagccgcctaagaaaagattcagatacgctccaattgcgatgcttgagaatagagagaaaatggccagtaaggattctgaagctgatgctttaggggaagagagtgataaatttgacactgatgaatctccattgcacaaaggctttgagctggacatgaacatgacagacaccgaccaaactaaggaagcaaaaacaactcgtcactggagactgggactgtgtctgaattctcaagggactgaagaatga

SEQ ID NO: 622 - protein, 163 aa, Brassica napus
MEGVGSRLSRTTRYSGPSATAVFNGRVRKWKKKWVSVSTSSVGIFRASKPNGRSTSQHHMLLHKWTPLSSATVTASGETEEPPKKRFRYAPIAMLENREKMASKDSEADALGEESDKFDTDESPLHKGFELDMNMTDTDQTKEAKTTRHWRLGLCLNSQGTEE

SEQ ID NO: 623 - DNA, 504 bp, Brassica napus
atggaaggcgtagggtcgagattgagccgaacgtcatcgagatacagtggtccggctgcgacggcggttttcagcggccgtgtaaggaagtggaagaagaagtgggtacgtgtctccacgtcaccagtcggcgttttccgagcatctaaatccaacggtcgtagcaacaacaacaacagcagcagcaattctccacaccatctgcttctccataagtggaccccacttccctctgacgctaacggctccggtgagacggaggagccgcctaaacgaagattcagatacgctccaattgcgatgtttgagcatagggagagagtgggtgctaaggattctgaggttgaagcggaagagactgacgaattcgacaatgattctccattgcctaaagccgttggtctggacatgaacttaactgactccgaccaaactaaggaggcaaaaactcgtcacttgaaactgggactgtgtcttaattctgaagggactgaagaagaatga

SEQ ID NO: 624 - protein, 167 aa, Brassica napus
MEGVGSRLSRTSSRYSGPAATAVFSGRVRKWKKKWVRVSTSPVGVFRASKSNGRSNNNNSSSNSPHHLLLHKWTPLPSDANGSGETEEPPKRRFRYAPIAMFEHRERVGAKDSEVEAEETDEFDNDSPLPKAVGLDMNLTDSDQTKEAKTRHLKLGLCLNSEGTEEE

SEQ ID NO: 625 - DNA, 507 bp, Brassica napus
atggaaggcgtagggtcgagattgagccgaacgtcatcgagatatagtggtccggctgcgacggcggtgttcagcggccgtgtaaggaagtggaagaagaagtgggtacgtgtctccacgtcaccagtcggcgttttccgagcatctaaatccaacggtcgtagcaacaacaacaacaacagcagcagcaattccccacaccatctgcttctccataagtggaccccacttccctccgaagctaacggctccggtgagacggaggagccgcctaaacgaagattcagatacgctcctattgcgatgtttgagcatagggagagagtgggtgctaaggattctgaggttgaagcggaagagactgacgaattcgacaatgattctccattgcctaaagccgttgggctggacatgaacttaactgactcagaccaaactaaggaggcaaaaactcgtcacttgaaactgggactgtgtcttaattctgaagggactgaagaagaatga

SEQ ID NO: 626 - protein, 168 aa, Brassica napus
MEGVGSRLSRTSSRYSGPAATAVFSGRVRKWKKKWVRVSTSPVGVFRASKSNGRSNNNNNSSSNSPHHLLLHKWTPLPSEANGSGETEEPPKRRFRYAPIAMFEHRERVGAKDSEVEAEETDEFDNDSPLPKAVGLDMNLTDSDQTKEAKTRHLKLGLCLNSEGTEEE

SEQ ID NO: 627 - DNA, 531 bp, Glycine max
atggaggcggtgggctcgagactcagccgcgccacctcccgttacggcgcccccacggtgttcagcggccccgtcagaaagtggaagaagaagtgggtccacgtcaccccctcttccttacccaacaacaactcacactctcacaccaacaacttcaccaccaccaccaccaacgattcctctcgcctcctcctccgccgttggactccaactaccgccgatgactccgccggagccgtctccgacgatcctccccgaagaaagttccgttacacccctattgctgtgctagaagaacagaaaaagatgaatgttgtgaaggctgaacatgaacccacaattgaggctgaccaattggcatttagacagacaaatgtgactcacgagatgcaggggaaactaaacatgaatgaaatgttggaggaaaccaaggattcaaacattggtaatttggatcttggttcagacttccaaagcaacaccggtgaaaacagccacgacagtgattctcaattggaaaatagtatctag

SEQ ID NO: 628 - protein, 176 aa, Glycine max
MEAVGSRLSRATSRYGAPTVFSGPVRKWKKKWVHVTPSSLPNNNSHSHTNNFTTTTTNDSSRLLLRRWTPTTADDSAGAVSDDPPRRKFRYTPIAVLEEQKKMNVVKAEHEPTIEADQLAFRQTNVTHEMQGKLNMNEMLEETKDSNIGNLDLGSDFQSNTGENSHDSDSQLENSI

SEQ ID NO: 629 - DNA, 609 bp, Glycine max
atggagggagttggggcccggcttgggcggtcctcgacccgctacggaccggccacggtgttcactggaccggtccggaagtggaagaagaaatggatccacgtgtccccttcttctgcttcctctaattccaacgccaataatcatcacaaccacgcttcccatgcctctcatcttctcctctacaagtggacccctctcacccacagccagaacaccgccactactaacaacgctaacgccaaggactcgcctccggagcctcccgaggaaccgcctcgaaggaaattcaaatatgttccggttgctctactagaggagcagaaaaatgagggtgcagaaagtgagggtactgagaaggttgacgaggaatctaaaccaattgatgctgattcaggtgcagcagaagcaactcacaagaatgagactttggatgaaaaacctgacataaatgatgtcccaatggaagaaagtcagtctcagtacaaaaatcaagtggtgcgccaagatctgaatgaaagcacattggacttaagtttgggcttgacatcacatgatgatgaacatgattctgattcaaaaactaatcaaacaagagatggccagtaa

SEQ ID NO: 630 - protein, 202 aa, Glycine max
MEGVGARLGRSSTRYGPATVFTGPVRKWKKKWIHVSPSSASSNSNANNHHNHASHASHLLLYKWTPLTHSQNTATTNNANAKDSPPEPPEEPPRRKFKYVPVALLEEQKNEGAESEGTEKVDEESKPIDADSGAAEATHKNETLDEKPDINDVPMEESQSQYKNQVVRQDLNESTLDLSLGLTSHDDEHDSDSKTNQTRDGQ

SEQ ID NO: 631 - DNA, 606 bp, Glycine max
atggagggagttggggcccggctggggcggtcctcgacccggtacggaccggccacggtgttcactggaccggtgcggaagtggaagaagaaatggatccacgtgtccccctcttctgcttcctctaattccaacgccaataaccacgcttccaatgcctctcatcttctcctctacaagtggacccctctcacccaaagccagaacaccaccaacaacgccaacgctaacggtaatgccaaggacgcgccgccggagccacccgcggaaccgcctcgaagaaaattcaaatatgttccggttgctctactagaggagcaaaaaaatgaggctgcagaaaatgagggtactgagaaggttgacgaggaatctaaaccaattgatgttgattcaggtgcagcagaggcaactcgcaagaatgagactttggatgaaaaacctgacataaatgatgtcccaatggaagaaagtcagtctcagtacaaaaatcaggtggtgcgccaagatctgaatgaaagcaccttggatttaagtttgggcttgacatcacatgatgatgaacatgattctgattcaaaaactaatcaaacgagagatggccagtaa

SEQ ID NO: 632 - protein, 201 aa, Glycine max
MEGVGARLGRSSTRYGPATVFTGPVRKWKKKWIHVSPSSASSNSNANNHASNASHLLLYKWTPLTQSQNTTNNANANGNAKDAPPEPPAEPPRRKFKYVPVALLEEQKNEAAENEGTEKVDEESKPIDVDSGAAEATRKNETLDEKPDINDVPMEESQSQYKNQVVRQDLNESTLDLSLGLTSHDDEHDSDSKTNQTRDGQ

SEQ ID NO: 633 - DNA, 528 bp, Glycine max
atggaggcggtgggttcgagactcagccgcgcctcctcccgctacggcgcccccaccgtgttcagcggccccgtcagaaagtggaagaagaagtgggtccacgtcaccccctcttccttacccaacaacagctctcactctcacactaacaactccaccaccaccagcagcgcttcctctcgcctcctccttcgccgttggactcccgccaccgtcgacgacgccgccggagccgtctccgacgagcctccccgaagaaagttccgttacaccccggttgttgtcctagaagaacagaaaaagatgaatgttgtgaaggctgaacatgaacccacaattgagactgaccaattggctgctaggaagacaaatgtgactcatgagatgcagggaaaactgaacatgaatgaaatgttggaggaaaccaaggattcaaacattggtaatttagatcttggttcagacttccaaagcaacaccggtggaaacagccagaacagtgattctcaattggaaaatagtatgtaa

SEQ ID NO: 634 - protein, 175 aa, Glycine max
MEAVGSRLSRASSRYGAPTVFSGPVRKWKKKWVHVTPSSLPNNSSHSHTNNSTTTSSASSRLLLRRWTPATVDDAAGAVSDEPPRRKFRYTPVVVLEEQKKMNVVKAEHEPTIETDQLAARKTNVTHEMQGKLNMNEMLEETKDSNIGNLDLGSDFQSNTGGNSQNSDSQLENSM

SEQ ID NO: 635 - DNA, 450 bp, Hordeum vulgare
atggacaccgtgggcgcccggctgagccgctcctccacgcgctatggccccgtcggcagcagcaacgcctccttcagcgggcccgtcaggaagtggcgcaaggcgtgggcccctctcgccggcggcggcgcggggtccgcctccgccggtatgggtcccattgggtgccccaggggtaacaagggggtgctgctcaagtgggcgccagtgagcggcgctggcgacggcaacggcaaggaggtcgccgcgacggccacccgacggcgctacgttccggtttcgggtgtgccacagaaccctaccagaaaaagcggcagcaccgagctgaacctgaaccttggtttggaggatccggatgatgacagggacgctgatttgagcccagacgaacaagaggacacgggcagcaccccgcgttccgaaaaccgactgaagaggaaagtgttttaa

SEQ ID NO: 636 - protein, 149 aa, Hordeum vulgare
MDTVGARLSRSSTRYGPVGSSNASFSGPVRKWRKAWAPLAGGGAGSASAGMGPIGCPRGNKGVLLKWAPVSGAGDGNGKEVAATATRRRYVPVSGVPQNPTRKSGSTELNLNLGLEDPDDDRDADLSPDEQEDTGSTPRSENRLKRKVF

SEQ ID NO: 637 - DNA, 432 bp, Hordeum vulgare
atggagggtgttggcgcgcgattagggcgttcgtcggcccgttacggccccgcgatgacgttcaccgggcccgttaggaagtggcggaaggaatgggtccccatctccgccgccacggccacggcctcctccgccgggactggatctcgcggaaataacctcatcctgttcaagtggaccccgtttaacggctccaacgaaggagatgaggagcagacggcaccggcgaagacggccacgagaaggcggcggtacgtgccggtttctgtagttcaagatcaaaggcaagaatctgccaaatctgatgatgagaacaaggctaatgatggagaaccttcatctacggaaacagagcagtctattgggaaaactaatatcgatgatatacttatggatgaatcccaggtaaaatggacttatttagctgtataa

SEQ ID NO: 638 - protein, 143 aa, Hordeum vulgare
MEGVGARLGRSSARYGPAMTFTGPVRKWRKEWVPISAATATASSAGTGSRGNNLILFKWTPFNGSNEGDEEQTAPAKTATRRRRYVPVSVVQDQRQESAKSDDENKANDGEPSSTETEQSIGKTNIDDILMDESQVKWTYLAV

SEQ ID NO: 639 - DNA, 627 bp, Medicago truncatula
atggaaggagttggggcccgactggggcggtcctcgacccgttacggaccggcaacggttttcaccggaccggttagaaaatggaagaagaaatgggttcatgttttaccttcatcttcttcatctaattccaacaacaacaacgcgaatcaaaatcacgctaacggtagtaacggtaataacggttctcatcttcttctttttaagtggactcctattactcaaagccagaacaacgccaacggtaatggaaatggaagtgttaaggatgcggcggtggagccggtggaagagccaccgcggcgcaagtttaaatatgttccggttgctgtactagaggagcagaaaaacgaggctaccgaagatgaggttgccgaaaaggttgaagatgaatctaatccaatagaggctgattcaagtgcagcagaaccaaccagcaagaatgagactttggatgaaaaacctgatataaatgatgtcccaatggaagaaagcgagcctcaggacaaaaatcaggtagtacgccaagatctcaatgaaagtttggatttgagtttgggtttgacatcacatgatgaagatcaagattctgattcaaaaactaatcaacctacagatggtcagtaa

SEQ ID NO: 640 - protein, 208 aa, Medicago truncatula
MEGVGARLGRSSTRYGPATVFTGPVRKWKKKWVHVLPSSSSSNSNNNNANQNHANGSNGNNGSHLLLFKWTPITQSQNNANGNGNGSVKDAAVEPVEEPPRRKFKYVPVAVLEEQKNEATEDEVAEKVEDESNPIEADSSAAEPTSKNETLDEKPDINDVPMEESEPQDKNQVVRQDLNESLDLSLGLTSHDEDQDSDSKTNQPTDGQ

SEQ ID NO: 641 - DNA, 312 bp, Medicago truncatula
atggagacagtgggttctacgaggttgggtagagcatcttcacgctacggtgcacctgcagtgttcaatggtcctgttcgtaaatgggagaagaaatgggttcatgtttcaccttcttcgtttaacaacaacaagaaaaataataaggataatagtaacgagaaatctcgtttacttcttcgtcgttggactccggttgcgaattcttcttctgctgaggatgtttctgatgagccacctagaaggaagtttcgttatactcctattgctgcgctagaagaacagaaaaaggggggctgtggaaaaggttga

SEQ ID NO: 642 - protein, 103 aa, Medicago truncatula
METVGSTRLGRASSRYGAPAVFNGPVRKWEKKWVHVSPSSFNNNKKNNKDNSNEKSRLLLRRWTPVANSSSAEDVSDEPPRRKFRYTPIAALEEQKKGGCGKG

SEQ ID NO: 643 - DNA, 648 bp, Oryza sativa
atggagggcgtgggcgcgcggctcgggcgcacctcggcccgctacggcaccacgacgacgttcacggggcccgtcaggaagtggcgcaaggactgggtgcccgtcgccgccgccgccgccgcggcggcggcggcggcgtcggccgcctcctccacggcgggggccggatcccgcgggaacaatctcgtgctcttcaagtggaccccgatgaacggcgccaacggcaacgggggcggaggagacggagaccaggcggcggcggcggccgccgccgcggaggaggagaaggccacgaaacggcggcggtacgtgccggtttctgtagttgaagatgaaaggcaagaatctggaaaatctgacgatgaaaataaggcaaatgatggagaaccatcatccgccgaaactgagccatctaatggaaaaactaatattaatgatacaccaatggatgaatctcaggcatcagatgaggcccgatattctggcaaaaatggcggtggaaccgacctaaatttaaacttgggtctgaaggaccctgacggagacaatgatattgatactgaagaacaagatgctgaaaacaacacacacacagaaaataggctgaagaggaaatctgtagctcctgaccttgagatgagaatgtaa

SEQ ID NO: 644 - protein, 215 aa, Oryza sativa
MEGVGARLGRTSARYGTTTTFTGPVRKWRKDWVPVAAAAAAAAAAASAASSTAGAGSRGNNLVLFKWTPMNGANGNGGGGDGDQAAAAAAAAEEEKATKRRRYVPVSVVEDERQESGKSDDENKANDGEPSSAETEPSNGKTNINDTPMDESQASDEARYSGKNGGGTDLNLNLGLKDPDGDNDIDTEEQDAENNTHTENRLKRKSVAPDLEMRM

SEQ ID NO: 645 - DNA, 315 bp, Oryza sativa
atggagggcgtgggcgcgcggctcgggcgcacctcggcccgctacggcaccacgacgacgttcacggggcccgtcaggaagtggcgcaaggactgggtgcccgtcgccgccgccgccgccgcggcggcggcggcggcgtcggccgcctcctccacggcgggggccggatcccgcgggaacaatctcgtgctcttcaagtggaccccgatgaacggcgccaacggcaacgggggcggaggagacggagaccaggcggcggcggcggccgccgccgcggaggaggagaaggccacgaaacggcggcggtttctgtag

SEQ ID NO: 646 - protein, 104 aa, Oryza sativa
MEGVGARLGRTSARYGTTTTFTGPVRKWRKDWVPVAAAAAAAAAAASAASSTAGAGSRGNNLVLFKWTPMNGANGNGGGGDGDQAAAAAAAAEEEKATKRRRFL

SEQ ID NO: 647 - DNA, 468 bp, Oryza sativa
atggacaccgtgggcgcccgcctgagccgctcgtcgacgcggtacggccccgtcgggaacaccgcctcctccttcagcgggcccgtcaggaagtggcgcaaggcctgggtccccatcgccgccggcggggcggggtacgccgggatgatgggccccatgggtgtctccagggggaacaaggtggtgctgttcaggtgggcgccggtgaacggcggcgcggccgggggtggcggtggcagcggcgacggcgacgagtcggcagcggtggcggccaccaggcggcgcttcgttccggcttcaggcgtggcacaaaattctaccaagaagagcggcagcaccgagctgaatttgaaccttgggttggaagatccagatgacgacagcgatgctgatctgagcgcagaagagcaacgtgacagtggaagtaaccaacgctcagacaacagactgaagagaaaagccttttaa

SEQ ID NO: 648 - protein, 155 aa, Oryza sativa
MDTVGARLSRSSTRYGPVGNTASSFSGPVRKWRKAWVPIAAGGAGYAGMMGPMGVSRGNKVVLFRWAPVNGGAAGGGGGSGDGDESAAVAATRRRFVPASGVAQNSTKKSGSTELNLNLGLEDPDDDSDADLSAEEQRDSGSNQRSDNRLKRKAF

SEQ ID NO: 649 - DNA, 1074 bp, Physcomitrella patens
atgatagcgaaagaaagaaagaaaagtgaaggaaagaaagaaaagcaaaagaaagaaaggaaagggaggaaaagagagaaaagcgagggaaagaaaggaaagggagggaaagagagaaaagcgagggaaagaaagcgagggaagaaaacgaaggaaacgaaggtggtgttgggaaaggcacgaccaagcagagctcgcggagcatcgagggagggagggagagcgagtgagggagctcgatcgatcacacacagacacacagcggagcaccgcacggtggccttacctcattcagttcgtgtcgatccctgcactctctgccatgccatgcgttctcattccctcgtgatcgcctccacgcttcccctcaccctctcgccattcccatttttgcactgtctcgcgcccgctcaggatcactgcgcattgcatcgtttggttcctggagggcgatgtttagggttctgggaggtcaagatggaagggggtttggggagtacgcgaatgggcagtcggtcgtccactcgccatggtccggcatcggtattccaaggtcgagtgcggcgatggaagaagtcttgggctcccgtggcgccttcgtccactccttccgctgcagcttgtcgtgttcttctttacaaatggtcgcctatcacggtacccgctgctaacgggacgaaagagtccactccggaggagccaccaccagcgaaacccttgcgatatttgcctgtttcagtaatcctgcaacagaagaaggaagaagctcagaaagctgaagaagaagctgaaactctgtcaagattagaacaagaggcagtggctgccacaagtccagcacaggagaaggatggagctgaggcggctggtacccaacaggatacaagcatgggtgattctcaaccagaacaagctggtgatccaataaccaaagttgatgaaggtgcaaatgccactgaggctggagaacaagaggttcaagatgtcacggaagcaaatcaagcggaacaggaacaggacgagagcactgcacaagaaccagaggctacatctatggatgtgactcaaggttga

SEQ ID NO: 650 - protein, 357 aa, Physcomitrella patens
MIAKERKKSEGKKEKQKKERKGRKREKSEGKKGKGGKERKARERKRGKKTKETKVVLGKARPSRARGASREGGRASEGARSITHRHTAEHRTVALPHSVRVDPCTLCHAMRSHSLVIASTLPLTLSPFPFLHCLAPAQDHCALHRLVPGGRCLGFWEVKMEGGLGSTRMGSRSSTRHGPASVFQGRVRRWKKSWAPVAPSSTPSAAACRVLLYKWSPITVPAANGTKESTPEEPPPAKPLRYLPVSVILQQKKEEAQKAEEEAETLSRLEQEAVAATSPAQEKDGAEAAGTQQDTSMGDSQPEQAGDPITKVDEGANATEAGEQEVQDVTEANQAEQEQDESTAQEPEATSMDVTQG

SEQ ID NO: 651 - DNA, 399 bp, Populus trichocarpa
atggaaggagtcggggcacggctggggaggtcttccactcgctacgggccggccacggtgttcagtgggccggtgaggaagtggaagaagagatgggtccatgtcaacccatcatccaaccacaacagctttcactctcatcaccataacgctactactaatgctgctgctgcttcttcttcagccgctaatcattcgagctcttctaacggtaataacggctcccatctattgctttacaagtggaccgctttgtctcaatccaacggttcctcatctactactaaccacttcaacggtaataatattaatactactaacgaaattgctaatctctccaatggcgacgtcaccgaggagcctcccaggcgtaaattcaaatacatcccggttgcctga

SEQ ID NO: 652 - protein, 132 aa, Populus trichocarpa
MEGVGARLGRSSTRYGPATVFSGPVRKWKKRWVHVNPSSNHNSFHSHHHNATTNAAAASSSAANHSSSSNGNNGSHLLLYKWTALSQSNGSSSTTNHFNGNNINTTNEIANLSNGDVTEEPPRRKFKYIPVA

SEQ ID NO: 653 - DNA, 717 bp, Populus trichocarpa
atgtcggtccttaagggctttgcctcaactcccagcgagcagtcctcacgtatcctctgctctgctgaattatatcttttacccaaaaaaccggcgattcctgaaaaacaaagccgagattttggggtgagaaaaatggagggagtgggatctcggttgggccggtcttcgtctcggtacggcctatcagcgacggccgctgttcttaatggccccgtcaggaagtggaagaggaaatgggtccacgtgtccccttctcccaccctcaattaccgcaacaacagccactccaacggccataacaacaacaacaacaacaacaacaacggctctcgcctcctcctctgtcggtggactccactacccccctctggggccaccgccgctacctcctcctccgaggatccacctaaacgcaaattccgttacaccccaattgctgtactggaggaacgtagcaaggtagaaaagaaggttgaacaagaagttgagaagcagttggtagggtggctaacttctaaggatgatagacaaaatattggagatggtctcaagagtgaaattcaggattcaaacatgagccatttggatttggatttggatttgcgcttaaaaggcctcaacaatgatcttgactctgttggccaaagcgaagaggatcaagtgaagaaagcaagctcaggtgggtttggacgagtggttgacccaagaaactga

SEQ ID NO: 654 - protein, 238 aa, Populus trichocarpa
MSVLKGFASTPSEQSSRILCSAELYLLPKKPAIPEKQSRDFGVRKMEGVGSRLGRSSSRYGLSATAAVLNGPVRKWKRKWVHVSPSPTLNYRNNSHSNGHNNNNNNNNNGSRLLLCRWTPLPPSGATAATSSSEDPPKRKFRYTPIAVLEERSKVEKKVEQEVEKQLVGWLTSKDDRQNIGDGLKSEIQDSNMSHLDLDLDLRLKGLNNDLDSVGQSEEDQVKKASSGGFGRVVDPRN

SEQ ID NO: 655 - DNA, 639 bp, Populus trichocarpa
atggaaggagtcggggcgcggctggggagatcttcgactcggtacgggccggccacggtgttcagcgggccggttaggaagtggaagaagagatgggtccacgtaacccctccgtcatcttcatcaaaccataacaacactcattcgcatcaccataacgctattagtaatggcactgccgctgctaacaattcaagctcttctaacggtaataacggctcccatctcttgctttataagtggacccctttgtctcaatccaacggttcttcttctccttctcctgccactaacaacaacggtaacagcaacaatgatgataataaaaacaatgctaatctctccaacggcgacgcccccgatgagcctcccaggcgtaaattcaaatacattccggttgatctgctagagaaacagaagaaagaggctgaagaacaagaggcctttgaaaaggttgatgatgaatctaaactgaatgatactgaccctaaagcagaactagtttccaagagtgacagcgctgaagaaaaacctgacataaatgatatacccatggaagaaaatgaggatgataatcaagtggtacgacaagatctgaatgaaagcactttggatttgagtttaggcttggtctcttga

SEQ ID NO: 656 - protein, 212 aa, Populus trichocarpa
MEGVGARLGRSSTRYGPATVFSGPVRKWKKRWVHVTPPSSSSNHNNTHSHHHNAISNGTAAANNSSSSNGNNGSHLLLYKWTPLSQSNGSSSPSPATNNNGNSNNDDNKNNANLSNGDAPDEPPRRKFKYIPVDLLEKQKKEAEEQEAFEKVDDESKLNDTDPKAELVSKSDSAEEKPDINDIPMEENEDDNQVVRQDLNESTLDLSLGLVS

SEQ ID NO: 657 - DNA, 366 bp, Triticum aestivum
atggagggcgttggcgcgcggttagggcgctcgtcggcccgttacggccccgcgatgacgttcacggggcccgttaggaagtggcggaaggaatgggtcaccatctccgccgccacggccacggccacctccgccgcggcctcctccaccgggactggatctcgtggaaataacctcatcctgttcaagtggaccccgctgaacggcgccaacgaaggagatgaggagcagacggcaccggcgaagacggccacgagaaggcggcggtacgtgccggtttctgtagttcaagatcaaaggcaagaatctgccaaatctgatgatgagaacaaggctaatgatggagaacttcatctacgaaactga

SEQ ID NO: 658 - protein, 121 aa, Triticum aestivum
MEGVGARLGRSSARYGPAMTFTGPVRKWRKEWVTISAATATATSAAASSTGTGSRGNNLILFKWTPLNGANEGDEEQTAPAKTATRRRRYVPVSVVQDQRQESAKSDDENKANDGELHLRN

SEQ ID NO: 659 - DNA, 600 bp, Triticum aestivum
atggagggcgttggcgcgcggttagggcgctcgtcggcccgttacggccccgcgatgacgttcacggggcccgttaggaagtggcggaaggaatgggtcaccatctccgccgccacggccacggccacctccgccgcggcctcctccaccgggactggatctcgtggaaataacctcatcctgttcaagtggaccccgctgaacggcgccaacgaaggagatgaggagcagacggcaccggcgaagacggccacgagaaggcggcggtacgtgccggtttctgtagttcaagatcaaaggcaagaatctgccaaatctgatgatgagaacaaggctaatgatggagaaccttcatctacggaaactgagcagtctattgggaaaactaatatggatgatatacttatggatgagtcccaggcatcagatgaggttcgagattctggaaatttcgttggtggaaccgatctaaatctgaacttaggtccgaaagaccccgacggtgaagatgaaggtgatacaggtaagcaacacgaggctcgaacagaacacagattgaagaggaaatctgttacccctgacctcgagatgagaatgtaa

SEQ ID NO: 660 - protein, 199 aa, Triticum aestivum
MEGVGARLGRSSARYGPAMTFTGPVRKWRKEWVTISAATATATSAAASSTGTGSRGNNLILFKWTPLNGANEGDEEQTAPAKTATRRRRYVPVSVVQDQRQESAKSDDENKANDGEPSSTETEQSIGKTNMDDILMDESQASDEVRDSGNFVGGTDLNLNLGPKDPDGEDEGDTGKQHEARTEHRLKRKSVTPDLEMRM

SEQ ID NO: 661 - DNA, 516 bp, Zea mays
atggagggtgtgggcgcgcggctagggcgcacttcggcgcgctacgggccggcgacgacgttcacgggccatgtcaggaagtggcgcaaggagtgggtaccagtggtcgccgccgccgccgccgccgccgccaacgccaacaccagcgccaacggtggcacgacgtcctccacggggatgggatctggcggaggatcccgcgggaataatcttctcctgtttaagtggaccccggtgaacggggctaacgggggaggaggggatggggagcagcagcagcaggctgagacggccacgagacgccggcggtatgtgccggtttctttaatggaagagcaaaggcaagaatctaccaaatctgatgatgagaacaaagctaatgatggagatccatcttcgaatgaaactgagccatcaaatggaaagactgatatcaatgatacacctatggatgaatctcaggcaacagatgaggatggtcgaaattctggaaaaacggccgggggaacaaactaa

SEQ ID NO: 662 - protein, 171 aa, Zea mays
MEGVGARLGRTSARYGPATTFTGHVRKWRKEWVPVVAAAAAAAANANTSANGGTTSSTGMGSGGGSRGNNLLLFKWTPVNGANGGGGDGEQQQQAETATRRRRYVPVSLMEEQRQESTKSDDENKANDGDPSSNETEPSNGKTDINDTPMDESQATDEDGRNSGKTAGGTN

SEQ ID NO: 663 - DNA, 657 bp, Zea mays
atggagggtgtgggcgcgcggctagggcgcacttcggcgcgctacgggccggcgacgacgttcacgggccatgtcaggaagtggcgcaaggagtgggtaccagtggtcgccgccgccgccgccgccgccgccaacgccaacaccagcgccaacggtggcacgacgtcctccacggggatgggatctggcggaggatcccgcgggaataatcttctcctgtttaagtggaccccggtgaacggggctaacgggggaggaggggatggggagcagcagcagcaggctgagacggccacgagacgccggcggtatgtgccggtttctttaatggaagagcaaaggcaagaatctaccaaatctgatgatgagaacaaggctaatgatggagatccatcttcgaatgaaactgagccatcaaatggaaagactgatatcaatgatacacctatggatgaatctcaggcaacagatgaggatggtcgagattctggtaaaaacggcggtggaacagacctaaatttgaatttaggtttgaaagacccggatggtgataatgaagttgagacatcagagaaacatgtagcggcaaacaatccgcagacagagaatagatccaagaggaaatccgtaacccctgaccttgagatgacaatgtaa

SEQ ID NO: 664 - protein, 218 aa, Zea mays
MEGVGARLGRTSARYGPATTFTGHVRKWRKEWVPVVAAAAAAAANANTSANGGTTSSTGMGSGGGSRGNNLLLFKWTPVNGANGGGGDGEQQQQAETATRRRRYVPVSLMEEQRQESTKSDDENKANDGDPSSNETEPSNGKTDINDTPMDESQATDEDGRDSGKNGGGTDLNLNLGLKDPDGDNEVETSEKHVAANNPQTENRSKRKSVTPDLEMTM

SEQ ID NO: 665 - DNA, 2194 bp, Oryza sativa
aatccgaaaagtttctgcaccgttttcaccccctaactaacaatatagggaacgtgtgctaaatataaaatgagaccttatatatgtagcgctgataactagaactatgcaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagagattttttttaaaaaaatagaatgaagatattctgaacgtattggcaaagatttaaacatataattatataattttatagtttgtgcattcgtcatatcgcacatcattaaggacatgtcttactccatcccaatttttatttagtaattaaagacaattgacttatttttattatttatcttttttcgattagatgcaaggtacttacgcacacactttgtgctcatgtgcatgtgtgagtgcacctcctcaatacacgttcaactagcaacacatctctaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctccttctcccatctataaattcctccccccttttcccctctctatataggaggcatccaagccaagaagagggagagcaccaaggacacgcgactagcagaagccgagcgaccgccttctcgatccatatcttccggtcgagttcttggtcgatctcttccctcctccacctcctcctcacagggtatgtgcctcccttcggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggatcggaatcttgcgattttgtgagtaccttttgtttgaggtaaaatcagagcaccggtgattttgcttggtgtaataaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatgcattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagttc

SEQ ID NO: 666 - DNA, 1130 bp, Oryza sativa
catgcggctaatgtagatgctcactgcgctagtagtaaggtactccagtacattatggaatatacaaagctgtaatactcgtatcagcaagagagaggcacacaagttgtagcagtagcacaggattagaaaaacgggacgacaaatagtaatggaaaaacaaaaaaaaacaaggaaacacatggcaatataaatggagaaatcacaagaggaacagaatccgggcaatacgctgcgaaagtactcgtacgtaaaaaaaagaggcgcattcatgtgtggacagcgtgcagcagaagcagggatttgaaaccactcaaatccaccactgcaaaccttcaaacgaggccatggtttgaagcatagaaagcacaggtaagaagcacaacgccctcgctctccaccctcccacccaatcgcgacgcacctcgcggatcggtgacgtggcctcgccccccaaaaatatcccgcggcgtgaagctgacaccccgggcccacccacctgtcacgttggcacatgttggttatggttcccggccgcaccaaaatatcaacgcggcgcggcccaaaatttccaaaatcccgcccaagcccctggcgcgtgccgctcttccacccaggtccctctcgtaatccataatggcgtgtgtaccctcggctggttgtacgtgggcgggttaccctgggggtgtgggtggatgacgggtgggcccggaggaggtccggccccgcgcgtcatcgcggggcggggtgtagcgggtgcgaaaaggaggcgatcggtacgaaaattcaaattaggaggtggggggcggggcccttggagaataagcggaatcgcagatatgcccctgacttggcttggctcctcttcttcttatcccttgtcctcgcaaccccgcttccttctctcctctcctcttctcttctcttctctggtggtgtgggtgtgtccctgtctcccctctccttcctcctctcctttcccctcctctcttcccccctctcacaagagagagagcgccagactctccccaggtgaggtgagaccagtctttttgctcgattcgacgcgcctttcacgccgcctcgcgcggatctgaccgcttccctcggccttctcgcaggattcagcc

SEQ ID NO: 667 - DNA, 325 bp, Sugarcane bacilliform virus
gccatttaaatccagatctccaagacgtaagcaatgacgattgaggaggcattgacgtcagggatgaccgcagcggagagtactgggcccattcagtggatgctccactgagttgtattattgtgtgcttttcggacaagtgtgctgtccactttcttttggcacctgtgccactttattccttgtctgccacgatgcctttgcttagcttgtaagcaaggatcgcagtgcgtgtgtgacaccaccccccttccgacgctctgcctatataaggcaccgtctgtaagctcttacgatcatcggtagttcaccacatttaaatcgc

SEQ ID NO: 668 - DNA, 911 bp, Sugarcane bacilliform virus
agatctccaagacgtaagcaatgacgattgaggaggcattgacgtcagggatgaccgcagcggagagtactgggcccattcagtggatgctccactgagttgtattattgtgtgcttttcggacaagtgtgctgtccactttcttttggcacctgtgccactttattccttgtctgccacgatgcctttgcttagcttgtaagcaaggatcgcagtgcgtgtgtgacaccaccccccttccgacgctctgcctatataaggcaccgtctgtaagctcttacgatcatcggtagttcaccagtcgacaccgggccttcacctgcggagggtaagatccgatcaccatcttctgaatttctgttcttgatctgtcatgtataataactgtctagtcttggtgttggtgagatggaaattcggtggatctcggaagggatattgttcgtttgctggggttttttttgtgtgttgtgatccgtagagaatttgtgtttatccatgttgttgatcttggtatgtattcatgacatattgacatgcatgtgttgtatgtgtcatatgtgtgcctctccttgggatttgttttggataatagaacatgttatggactcaatagtctgtgaacaaatctttttttagatggtggccaaatctgatgatgatctttcttgagaggaaaaagttcatgatagaaaaatcttttttgagatggtggcttaatgtgatgatgatctttcttgagaggaaaaaaaagattcattataggagattttgatttagctcctttccaccgatattaaatgaggagcatgcatgctgattgctgataaggatctgatttttttatcccctcttctttgaacagacaagaaataggctctgaatttctgattgattatttgtacatgcag

SEQ ID NO: 669 - DNA, 1994 bp, Zea mays
tgcagtgcagcgtgacccggtcgtgcccctctctagagataatgagcattgcatgtctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaatagtttagatataaaatagaataaaataaagtgactaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaattctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattatttcgatcttgatatacttggatgatggcatatgcagcagctatatgtggatttttttagccctgccttcatacgctatttatttgcttggtactgtttcttttgtcgatgctcaccctgttgtttggtgttacttctgcag

SEQ ID NO: 670 - protein, 46 aa, Artificial sequence
  SNH domain
IQQYLDENKSLILKIVESQNSGKLSECAENQARLQRNLMYLAAIAD

SEQ ID NO: 671 - protein, 210 aa, Artificial sequence
  Preferred sequence for SYT polypeptide
MQQHLMQMQPMMAGYYPSNVTSDHIQQYLDENKSLILKIVESQNSGKLSECAENQARLQRNLMYLAAIADSQPQPPSVHSQYGSAGGGMIQGEGGSHYLQQQQATQQQQMTQQSLMAARSSMLYAQQQQQQQPYATLQHQQLHHSQLGMSSSSGGGGSSGLHILQGEAGGFHDFGRGKPEMGSGGGGEGRGGSSGDGGETLYLKSSDDGN

SEQ ID NO: 672 - DNA, 633 bp, Artificial sequence
  Nucleotide sequence encoding the preferred sequence for  the SYT polypeptide
atgcaacagcacctgatgcagatgcagcccatgatggctggttactaccccagcaatgttacctctgatcatatccaacagtacttggacgaaaacaaatcgttgattctgaagattgttgagtctcaaaactctggaaagcttagcgaatgcgccgagaatcaagcaaggcttcaacgcaacctaatgtacctagctgcaatagcagattctcagcctcagccaccaagtgtgcatagccagtatggatctgctggtggtgggatgattcagggagaaggagggtcacactatttgcagcagcaacaagcgactcaacagcaacagatgactcagcagtctctaatggcggctcgatcttcaatgttgtatgctcagcaacagcagcagcagcagccttacgcgacgcttcagcatcagcaattgcaccatagccagcttggaatgagctcgagcagcggaggaggaggaagcagtggtctccatatccttcagggagaggctggtgggtttcatgattttggccgtgggaagccggaaatgggaagtggtggtggcggtgaaggcagaggaggaagttcaggggatggtggagaaaccctttacttgaaatcatcagatgatgggaattga

The invention claimed is:

1. A method for enhancing a yield-related trait in a plant relative to a control plant, comprising increasing expression in a plant of:
   (i) a first nucleic acid encoding a polypeptide having at least 95% sequence identity to the amino acid sequence of SEQ ID NO: 188; and
   (ii) a second nucleic acid encoding a polypeptide having at least 95% sequence identity to the amino acid sequence of SEQ ID NO: 408.

2. The method of claim 1, wherein at least one of the polypeptides comprises an SNH domain having at least 40% sequence identity to the SNH domain of SEQ ID NO: 670.

3. The method of claim 1, wherein the first nucleic acid comprises the nucleotide sequence of SEQ ID NO: 187 or encodes a polypeptide comprising the amino acid sequence of SEQ ID NO: 188.

4. The method of claim 1, wherein the expression of the first nucleic acid and the second nucleic acid is increased by introducing and expressing the nucleic acids in said plant.

5. The method of claim 1, wherein the second nucleic acid comprises the nucleotide sequence of SEQ ID NO: 407 or encodes a polypeptide comprising the amino acid sequence of SEQ ID NO: 408.

6. The method of claim 1, wherein the first nucleic acid comprises the nucleotide sequence of SEQ ID NO: 187 or encodes a polypeptide comprising the amino acid sequence of SEQ ID NO: 188, and wherein the second nucleic acid comprises the nucleotide sequence of SEQ ID NO: 407 or encodes a polypeptide comprising the amino acid sequence of SEQ ID NO: 408.

7. The method of claim 1, wherein the enhanced yield-related trait comprises increased yield, increased biomass and/or increased seed yield relative to a control plant.

8. The method of claim 1, wherein the enhanced yield-related trait is obtained under non-stress conditions.

9. The method of claim 1, wherein the enhanced yield-related trait is obtained under conditions of drought stress, salt stress or nitrogen deficiency.

10. The method of claim 4, wherein the nucleic acids are operably linked to a plant promoter, a constitutive promoter, a GOS2 promoter, or a GOS2 promoter from rice.

11. The method of claim 1, wherein the nucleic acids are of plant origin.

12. A plant or part thereof, obtained by the method of claim 1.

13. A construct comprising:
   (i) a first nucleic acid encoding a polypeptide having at least 95% sequence identity to the amino acid sequence of SEQ ID NO: 188 and a second nucleic acid encoding a polypeptide having at least 95% sequence identity to the amino acid sequence of SEQ ID NO: 408;
   (ii) one or more control sequences capable of driving expression of the nucleic acids of (i), wherein the one or more control sequences comprises a plant promoter, a constitutive promoter, a GOS2 promoter, or a GOS2 promoter from rice; and optionally
   (iii) a transcription termination sequence.

14. The construct of claim 13, wherein the first nucleic acid comprises the nucleotide sequence of SEQ ID NO: 187 or encodes a polypeptide comprising the amino acid sequence of SEQ ID NO: 188.

15. A method for making a plant having increased yield, increased biomass and/or increased seed yield relative to a control plant, comprising transforming a plant, plant part, or plant cell with the construct of claim 13.

16. A plant, plant part or plant cell comprising the construct of claim 13.

17. The plant of claim 16, or a transgenic plant cell or transgenic plant part derived thereof, wherein said plant is a crop plant, a monocot, a cereal, rice, maize, wheat, barley, millet, rye, triticale, sorghum, emmer, spelt, secale, einkorn, teff, milo, or oats.

18. Harvestable parts of the plant of claim 17, wherein said harvestable parts are shoot biomass and/or seeds, and wherein said harvestable parts comprise said construct.

19. Products obtained from the plant of claim 17 and/or from harvestable parts thereof, wherein said products comprise said construct.

20. The construct of claim 13, wherein the second nucleic acid comprises the nucleotide sequence of SEQ ID NO: 407 or encodes a polypeptide comprising the amino acid sequence of SEQ ID NO: 408.

21. The construct of claim 13, wherein the first nucleic acid comprises the nucleotide sequence of SEQ ID NO: 187 or encodes a polypeptide comprising the amino acid sequence of SEQ ID NO: 188, and wherein the second nucleic acid comprises the nucleotide sequence of SEQ ID NO: 407 or encodes a polypeptide comprising the amino acid sequence of SEQ ID NO: 408.

22. A method for the production of a transgenic plant having increased yield, increased biomass, and/or increased seed yield relative to a control plant, comprising:
   (i) introducing and expressing in a plant or plant cell a first nucleic acid encoding a polypeptide having at least 70-%-95% sequence identity to the amino acid sequence of SEQ ID NO: 188 and a second nucleic acid encoding a polypeptide having at least 95% sequence identity to the amino acid sequence of SEQ ID NO: 408; and
   (ii) cultivating the plant or plant cell under conditions promoting plant growth and development.

23. The method of claim 22, wherein the first nucleic acid comprises the nucleotide sequence of SEQ ID NO: 187 or encodes a polypeptide comprising the amino acid sequence of SEQ ID NO: 188, and/or wherein the second nucleic acid comprises the nucleotide sequence of SEQ ID NO: 407 or encodes a polypeptide comprising the amino acid sequence of SEQ ID NO: 408.

24. A transgenic plant having increased yield, increased biomass, and/or increased seed yield, relative to a control plant, resulting from transgenic expression of a first nucleic acid encoding a polypeptide having at least 95% sequence identity to the amino acid sequence of SEQ ID NO: 188 and a second nucleic acid encoding a polypeptide having at least 95% sequence identity to the amino acid sequence of SEQ ID NO: 408, or a transgenic plant cell derived from said transgenic plant.

25. Products obtained from the transgenic plant of claim 24 and/or from harvestable parts thereof, wherein said produce comprise the first nucleic acid and the second nucleic acid.

26. Harvestable parts of the transgenic plant of claim 24, wherein said harvestable parts are shoot biomass and/or seeds, and wherein said harvestable parts comprise the first nucleic acid and the second nucleic acid.

27. The transgenic plant of claim 24, or a transgenic plant cell or transgenic plant part derived thereof, wherein said plant is a crop plant, a monocot, a cereal, rice, maize, wheat, barley, millet, rye, triticale, sorghum emmer, spelt, secale, einkorn, teff, milo, or oats.

28. The transgenic plant of claim 24, wherein the first nucleic acid comprises the nucleotide sequence of SEQ ID NO: 187 or encodes a polypeptide comprising the amino acid sequence of SEQ ID NO: 188, and/or wherein the second nucleic acid comprises the nucleotide sequence of SEQ ID NO: 407 or encodes a polypeptide comprising the amino acid sequence of SEQ ID NO: 408.

* * * * *